US007956177B2

(12) United States Patent
Benson et al.

(10) Patent No.: US 7,956,177 B2
(45) Date of Patent: Jun. 7, 2011

(54) DSRNA COMPOSITIONS AND METHODS FOR TREATING HPV INFECTION

(75) Inventors: John Benson, West Roxbury, MA (US); Birgit Bramlage, Kulmbach (DE); Kevin Fitzgerald, Brookline, MA (US); Pamela Tan, Kulmbach (DE); Hans-Peter Vornlocher, Bayreuth (DE)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 12/294,388

(22) PCT Filed: Mar. 23, 2007

(86) PCT No.: PCT/US2007/007241
§ 371 (c)(1),
(2), (4) Date: Sep. 24, 2008

(87) PCT Pub. No.: WO2007/111998
PCT Pub. Date: Oct. 4, 2007

(65) Prior Publication Data
US 2009/0247607 A1 Oct. 1, 2009

Related U.S. Application Data

(60) Provisional application No. 60/785,837, filed on Mar. 24, 2006, provisional application No. 60/825,782, filed on Sep. 15, 2006.

(51) Int. Cl.
C07H 21/04 (2006.01)
(52) U.S. Cl. .................. 536/24.5; 536/24.31; 536/24.1; 435/6; 435/325; 435/375; 514/44
(58) Field of Classification Search .......................... None
See application file for complete search history.

(56) References Cited

U.S. PATENT DOCUMENTS

| 5,858,987 | A * | 1/1999 | Beer-Romero et al. ..... 514/44 A |
| 2003/0143732 | A1 * | 7/2003 | Fosnaugh et al. ............. 435/325 |
| 2004/0259247 | A1 * | 12/2004 | Tuschl et al. .................. 435/375 |
| 2006/0275903 | A1 | 12/2006 | McSwiggen et al. |
| 2007/0004664 | A1 | 1/2007 | McSwiggen et al. |
| 2007/0031844 | A1 | 2/2007 | Khvorova et al. |

FOREIGN PATENT DOCUMENTS

| WO | WO 96/34950 A | 11/1996 |
| WO | 03/008573 A | 1/2003 |
| WO | WO 03/008573 A | 1/2003 |
| WO | 2004/065601 A | 8/2004 |
| WO | WO 2004/065601 A | 8/2004 |
| WO | WO 2008/116860 A2 | 10/2008 |

OTHER PUBLICATIONS

Hengstermann et al. Growth supression induced by downregulation of E6-AP expression in human papillomavirus—positive cancer cell lines depends on p53. J. of Virology 2005, vol. 79: 9296-9300.*

PCT International Search Report and Written Opinion, PCT/EP2008/053475, Jan. 19, 2009, 19 Pages.
PCT International Search Report and Written Opinion, PCT/US2007/007241, Apr. 7, 2007, 14 Pages.
Examination Report for European Patent Application No. 08718165.7, Apr. 28, 2010, 4 Pages.
Gewin, L., et al., "Identification of a novel telomerase repressor that interacts with the human papillomavirus type-16 E6/E6-AP complex" Genes & Development, Sep. 15, 2004, pp. 2269-2282, vol. 18, No. 18.
Patzel, V., et al., "In silico selection of active siRNA" Drug Discovery Today, Elsevier, Jan. 31, 2007, pp. 139-148, vol. 12, No. 3-4.
Shirakura, M., et al., "E6AP ubiquitin ligase mediates ubiquitylation and degradation of hepatitis C virus core protein." Journal of Virology, Feb. 2007, pp. 1174-1185, vol. 81, No. 3.
Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in *Drosophila melanogaster* Embryo Lysate", The EMBO Journal, 2001, pp. 6877-6888, vol. 20, No. 23.
Elbashir, S., et al., "RNA Interference is Mediated by 21-and 22 Nucleotide RNAs," Genes & Development, 2001, pp. 188-200, vol. 15.
Fire, A., "RNA-triggered Gene Silencing," Trends in Genetics, Sep. 1999, pp. 358-363, vol. 15, No. 9.
Fire, A., et al., "Potent and Specific Genetic Interference By Double Stranded RNA in *Caenorhabditis elegans*," Nature, Feb. 19, 1998, pp. 806-811, vol. 391.
Tuschl, T., "Functional genomics: RNA sets the standard," Nature, Jan. 16, 2003, vol. 421, No. 6920, pp. 220-221.
Tuschl T., "RNA Interference and Small Interfering RNAs" Chembiochem, 2001, pp. 239-245, vol. 2.
Tuschl, T., et al., "Small Interfering RNAs: A Revolutionary Tool for the Analysis of Gene Function and Gene Therapy," Molecular Interventions, 2002, pp. 158-167, vol. 2, No. 3.

(Continued)

*Primary Examiner* — Kimberly Chong
(74) *Attorney, Agent, or Firm* — Fenwick & West LLP

(57) ABSTRACT

The invention relates to a double-stranded ribonucleic acid (dsRNA) for treating human papilloma virus (HPV) infection. The dsRNA comprises an antisense strand having a nucleotide sequence which is less that 30 nucleotides in length, generally 19-25 nucleotides in length, and which is substantially complementary to at least a part of an HPV Target gene selected from among HPV E1, HPV E6 and the human E6AP gene. The invention also relates to a pharmaceutical composition comprising the dsRNA together with a pharmaceutically acceptable carrier; methods for treating diseases caused by HPV infection and the expression of the E6AP gene using the pharmaceutical composition; and methods for inhibiting the expression of the HPV Target genes in a cell.

20 Claims, No Drawings

OTHER PUBLICATIONS

Tuschl, T., "Mammalian RNA Interference," RNAi, A Guide to Gene Silencing, Chapter 13, G.J. Hannon (ed,), 2003, pp. 265-295.

Tuschl, T., et al., "Targeted mRNA Degradation By Double-Stranded RNA In Vitro," Genes & Development, 1999, pp. 3191-3197, vol. 13.

Tuschl, T., "Expanding small RNA interference," Nature Biotechnology, May 2002, pp. 446-448, vol. 20.

Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.

Liu Xuefeng et al. "The E6AP ubiquitin ligase is required for transactivation of the hTERT promoter by the human papillmavirus E6 oncoprotein" Journal of Biological Chemistry, vol. 280, No. 11, Mar. 2005, pp. 10807-10816, XP002462387 ISSN: 0021-9258.

Soutschek Juergen et al. "Therapeutic silencing of an endogenous gene by systemic administration of modified siRNA's" Nature, vol. 432, No. 7014, Nov. 11, 2004, pp. 173-178, XP002333747, ISSN: 0028-0836.

Kelley Melissa L. et al. "The global transcriptional effects of the human papillomavirus E6 protein in cervical carcinoma cell lines are mediated by the E6AP ubiquitin ligase" Journal of Virology, vol. 79, No. 6, Mar. 2005 pp. 3737-3747, XP002462388, ISSN: 0022-538X.

Scheffner M et al. "The HPV-16 E6 and E6-AP Complex Functions as a ubiquitin-protein ligase in the ubiquitination of P53" Cell, vol. 75, No. 3, Nov. 5, 1993, pp. 495-505, XP002014083 ISSN: 0092-8674.

Jiang, M., et al., "A bi-functional siRNA construct induces RNA interference and also primes PCR amplification for its own quantification," Nucleic Acids Research, 2005, vol. 33, No. 18, e151, 7 pages.

Hitchins, M., et al., "Investigation of UBE3A and MECP2 in Angelman Syndrome (AS) and Patients With Features of AS," American Journal of Medical Genetics, 2004, vol. 125A, pp. 167-172.

First Office Action for Chinese Patent Application No. 200780010541.0, Aug. 6, 2010, 20 Pages.

Examiner's First Report for Australia Patent Application No. 2007230995, Sep. 15, 2010, 2 Pages.

Second Office Action for Chinese Patent Application No. 200780010541.0, Jan. 11, 2011, 6 Pages.

Notification of Office Action for Russian Patent Application No. 2008141977, Nov. 19, 2010, 6 Pages.

* cited by examiner

DSRNA COMPOSITIONS AND METHODS FOR TREATING HPV INFECTION

FIELD OF THE INVENTION

This invention relates to double-stranded ribonucleic acid (dsRNA), and its use in mediating RNA interference to treat pathological processes mediated by human papillomavirus (HPV) infection, such as cervical cancer, anal cancer, HPV associated precancerous lesions, and genital warts.

BACKGROUND OF THE INVENTION

Papillomaviruses (PV) are non-enveloped DNA viruses that induce hyperproliferative lesions of the epithelia. The papillomaviruses are widespread in nature and have been recognized in higher vertebrates. Viruses have been characterized, amongst others, from humans, cattle, rabbits, horses, and dogs. The first papillomavirus was described in 1933 as cottontail rabbit papillomavirus (CRPV). Since then, the cottontail rabbit as well as bovine papillomavirus type 1 (BPV-1) have served as experimental prototypes for studies on papillomaviruses. Most animal papillomaviruses are associated with purely epithelial proliferative lesions, and most lesions in animals are cutaneous. In the human more than 100 types of papillomavirus (HPV) have been identified and they have been catalogued by site of infection: cutaneous epithelium and mucosal epithelium (oral and genital mucosa). The cutaneous-related diseases include flat warts, plantar warts, etc. The mucosal-related diseases include laryngeal papillomas and anogenital diseases comprising cervical carcinomas (Fields, 1996, Virology, 3rd ed. Lippincott—Raven Pub., Philadelphia, N.Y.; Bernard, H-U., 2005. J. Clin. Virol. 328: S1-S6).

Human papillomavirus (HPV) is one of the most prevalent sexually transmitted infections in the world. The majority of HPV infections are harmless. Some types of HPV cause genital warts, which appear as single or multiple bumps in the genital areas of men and women including the vagina, cervix, vulva (area outside of the vagina), penis, and rectum. Many people infected with HPV have no symptoms.

While most HPV subtypes result in benign lesions, certain subtypes are considered high-risk and can lead to more serious lesions, such as cervical and anal dysplasia. Fifteen HPV types were recently classified as high-risk types (Munoz, N. et al. 2003. N. Engl. J. Med. 348(6):518-27.) These high-risk subtypes are genetically diverse, demonstrating >10% sequence divergence at the L1 gene, a major virus capsid protein. (Bernard, H-U., 2005. J. Clin. Virol. 328: S1-S6).

Women having HPV infection are often asymptomatic and may only discover their lesion after cervical screening. Cervical screening is widely performed using the Pap test. A Pap test is a histological evaluation of cervical tissue which is used to identify abnormal cervical cells. As part of a Pap test, the presence of HPV infection and the specific subtype may be determined with the use of nucleic acid based assays such as PCR or the commercial Hybrid Capture II technique (HCII) (Digene, Gaithersburg, Md., U.S.A).

Abnormal cervical cells, if identified, are graded as LSIL (low-grade-squamous intraepithelial lesions) having a low risk of progressing to cancer (including CIN-1 designated cells ("cervical intraepithelial neoplasia-1")); or HSIL (High-grade squamous intraepithelial lesions), including CIN-2 and CIN-3 designated cells, having a higher likelihood of progressing to cancer.

About 85% of low-grade lesions spontaneously regress, and the remainder either stay unchanged, or progress to high-grade lesions. About 10% of high-grade lesions, if left untreated, are expected to transform into cancerous tissues. HPV-16 and HPV-18 are most often associated with dysplasias, although several other transforming HPV subtypes are also associated with dysplasias.

Recent studies indicate that up to 89% of HIV positive homosexual males may be infected with these high-risk subtypes of HPV. HIV positive patients are also more likely to be infected with multiple subtypes of HPV at the same time, which is associated with a higher risk of dysplasia progression.

Evidence over the last two decades has led to a broad acceptance that HPV infection is necessary, though not sufficient, for the development of cervical cancer. The presence of HPV in cervical cancer is estimated at 99.7%. Anal cancer is thought to have a similar association between HPV infection and the development of anal dysplasia and anal cancer as is the case with cervical cancer. In one study of HIV negative patients with anal cancer, HPV infection was found in 88% of anal cancers. In the US in 2003, 12,200 new cases of cervical cancer and 4,100 cervical-cancer deaths were predicted along with 4,000 new cases of anal cancer and 500 anal-cancer deaths. While the incidence of cervical cancer has decreased in the last four decades due to widespread preventive screening, the incidence of anal cancer is increasing. The increase in anal cancer incidence may be attributed in part to HIV infection since HIV positive patients have a higher incidence of anal cancer than the general population. While anal cancer has an incidence of 0.9 cases per 100,000 in the general population, anal cancer has an incidence of 35 cases per 100,000 in the homosexual male population and 70-100 cases per 100,000 in the HIV positive homosexual male population. In fact, due to the high prevalence of anal dysplasia among HIV-infected patients and a growing trend of anal cancers, the 2003 USPHA/IDSA Guidelines for the Treatment of Opportunistic Infections in HIV Positive Patients will include treatment guidelines for patients diagnosed with anal dysplasia.

There is no known cure for HPV infection. There are treatments for genital warts, although they often disappear even without treatment. The method of treatment depends on factors such as the size and location of the genital warts. Among the treatments used are Imiquimod cream, 20 percent podophyllin antimitotic solution, 0.5 percent podofilox solution, 5 percent 5-fluorouracil cream, and Trichloroacetic acid. The use of podophyllin or podofilox is not recommended for pregnant women because they are absorbed by the skin and may cause birth defects. The use of 5-fluorouracil cream is also not recommended for pregnant women. Small genital warts can be physically removed by freezing (cryosurgery), burning (electrocautery) or laser treatment. Large warts that do not responded to other treatment may have to be removed by surgery. Genital warts have been known to return following physical removal; in these instances α-interferon has been directly injected into these warts. However, α-interferon is expensive, and its use does not reduce the rate of return of the genital warts.

As such there exists an unmet need for effective HPV treatment. Surprisingly, compounds have been discovered that meet this need, and provide other benefits as well.

Recently, double-stranded RNA molecules (dsRNA) have been shown to block gene expression in a highly conserved regulatory mechanism known as RNA interference (RNAi). WO 99/32619 (Fire et al.) discloses the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al.). This natural mechanism has now become the focus for the development of a new class of pharmaceutical agents for treating disorders that are caused by the aberrant or unwanted regulation of a gene.

PCT Publication WO 03/008573 discloses a previous effort to develop a nucleic acid based medicament for the treatment of disease caused by HPV infection. This publication reports the use of two siRNAs directed to HPV mRNA to inhibit HPV replication in a cell based system; a related publication is found at Jiang, M. et al. 2005. N. A. R. 33(18): e151.

Despite significant advances in the field of RNAi and advances in the treatment of pathological processes mediated by HPV infection, there remains a need for agents that can inhibit the progression of HPV infection and that can treat diseases associated with HPV infection. The challenge is exacerbated because such agents must be designed to inhibit all the high-risk HPV subtypes, which together display a wide degree of genotypic diversity.

SUMMARY OF THE INVENTION

The invention provides a solution to the problem of treating diseases associated with HPV infection, by using double-stranded ribonucleic acid (dsRNA) to silence gene expression essential for HPV propagation. E6AP is a conserved gene of the human host species required by HPV for proliferation.

The invention provides double-stranded ribonucleic acid (dsRNA), as well as compositions and methods for inhibiting the expression of the E6AP gene in a cell or mammal using such dsRNA. The invention also provides compositions and methods for treating pathological conditions and diseases caused by the expression of the E6AP gene in connection with HPV infection, such as in cervical cancer and genital warts. The dsRNA of the invention comprises an RNA strand (the antisense strand) having a region which is less than 30 nucleotides in length, generally 19-24 nucleotides in length, and is substantially complementary to at least part of an mRNA transcript of the E6AP gene.

In one embodiment, the invention provides double-stranded ribonucleic acid (dsRNA) molecules for inhibiting the expression of the E6AP gene. The dsRNA comprises at least two sequences that are complementary to each other. The dsRNA comprises a sense strand comprising a first sequence and an antisense strand comprising a second sequence. The antisense strand comprises a nucleotide sequence which is substantially complementary to at least part of an mRNA encoding E6AP, and the region of complementarity is less than 30 nucleotides in length, generally 19-24 nucleotides in length. The dsRNA, upon contacting with a cell expressing the E6AP, inhibits the expression of the E6AP gene by at least 40%.

For example, the dsRNA molecules of the invention can be comprised of a first sequence of the dsRNA that is selected from the group consisting of the sense sequences of Table 1 and the second sequence is selected from the group consisting of the antisense sequences of Table 1. The dsRNA molecules of the invention can be comprised of naturally occurring nucleotides or can be comprised of at least one modified nucleotide, such as a 2'-O-methyl modified nucleotide, a nucleotide comprising a 5'-phosphorothioate group, and a terminal nucleotide linked to a cholesteryl derivative. Alternatively, the modified nucleotide may be chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide. Generally, such modified sequence will be based on a first sequence of said dsRNA selected from the group consisting of the sense sequences of Table 1 and a second sequence selected from the group consisting of the antisense sequences of Table 1.

In another embodiment, the invention provides a cell comprising one of the dsRNAs of the invention. The cell is generally a mammalian cell, such as a human cell.

In another embodiment, the invention provides a pharmaceutical composition for inhibiting the expression of the E6AP gene in an organism, generally a human subject, comprising one or more of the dsRNA of the invention and a pharmaceutically acceptable carrier or delivery vehicle.

In another embodiment, the invention provides a method for inhibiting the expression of the E6AP gene in a cell, comprising the following steps:

(a) introducing into the cell a double-stranded ribonucleic acid (dsRNA), wherein the dsRNA comprises at least two sequences that are complementary to each other. The dsRNA comprises a sense strand comprising a first sequence and an antisense strand comprising a second sequence. The antisense strand comprises a region of complementarity which is substantially complementary to at least a part of a mRNA encoding E6AP, and wherein the region of complementarity is less than 30 nucleotides in length, generally 19-24 nucleotides in length, and wherein the dsRNA, upon contact with a cell expressing the E6AP, inhibits expression of the E6AP gene by at least 40%; and (b) maintaining the cell produced in step (a) for a time sufficient to obtain degradation of the mRNA transcript of the E6AP gene, thereby inhibiting expression of the E6AP gene in the cell.

In another embodiment, the invention provides methods for treating, preventing or managing pathological processes mediated by HPV infection, e.g. cancer or genital warts, comprising administering to a patient in need of such treatment, prevention or management a therapeutically or prophylactically effective amount of one or more of the dsRNAs of the invention.

In another embodiment, the invention provides vectors for inhibiting the expression of the E6AP gene in a cell, comprising a regulatory sequence operably linked to a nucleotide sequence that encodes at least one strand of one of the dsRNA of the invention.

In another embodiment, the invention provides a cell comprising a vector for inhibiting the expression of the E6AP gene in a cell. The vector comprises a regulatory sequence operably linked to a nucleotide sequence that encodes at least one strand of one of the dsRNA of the invention.

BRIEF DESCRIPTION OF THE FIGURES

No Figures are presented

DETAILED DESCRIPTION OF THE INVENTION

The invention provides a solution to the problem of treating diseases associated with HPV infection, by using double-stranded ribonucleic acid (dsRNA) to silence expression of genes essential for HPV proliferation. In particular, the dsRNA of the invention silence the HPV genes E1 or E6 or human E6AP, a conserved gene of the human host species required by HPV for proliferation. Herein, these genes are sometimes collectively called the HPV Target genes.

The invention provides double-stranded ribonucleic acid (dsRNA), as well as compositions and methods, for inhibiting the expression of the E1, E6 or E6AP gene in a cell or mammal using the dsRNA. The invention also provides compositions and methods for treating pathological conditions and diseases in a mammal caused by the expression of the E1, E6 or E6AP gene in association with HPV infection using dsRNA. dsRNA directs the sequence-specific degradation of mRNA through a process known as RNA interference (RNAi).

The dsRNA of the invention comprises an RNA strand (the antisense strand) having a region which is less than 30 nucleotides in length, generally 19-24 nucleotides in length, and is substantially complementary to at least part of the HPV Target mRNA transcript. The use of these dsRNAs enables the targeted degradation of mRNAs of genes that are implicated in replication and/or maintenance of an HPV in mammals. Using cell-based and animal-based assays, the present inventors have demonstrated that very low dosages of these dsRNA can specifically and efficiently mediate RNAi, resulting in significant inhibition of expression of the E1, E6 or E6AP gene. Thus, the methods and compositions of the invention comprising these dsRNAs are useful for treating pathological processes mediated by HPV infection by targeting a host factor gene involved in the HPV life cycle.

Description of the HPV Targets: HPV E1 and E6 and Human E6AP

The cellular ubiquitin ligase E6AP of the human host is implicated in the replication of HPV, particularly integrated (non-episomal) forms of HPV, through its complex with the E6 protein of the virus. E6 binds to many proteins regulating cell proliferation pathways and often provokes their degradation (Chakrabarti, O. and Krishna, S. 2003. J. Biosci. 28:337-348). E6 complexes with E6AP to target the tumor suppressor p53 for degradation (Scheffner, M. et al., 1990. Cell. 63:1129-1136; and Scheffner, M. et al., 1993. Cell 75:495-505). By inactivating p53, the virus not only prevents p53-mediated apoptosis of the infected cells (Chakrabarti and Krishna, 2003) and facilitates the replication of its DNA that would otherwise be blocked by p53 (Lepik, D. et al. 1998. J. Virol. 72:6822-6831), but it also favors oncogenesis by decreasing p53-mediated control on genomic integrity (Thomas, M. et al. 1999. Oncogene. 18:7690-7700).

E1 and E6 are both described in considerable detail in "Papillomaviridae: The Viruses and Their Replication" by Peter M. Howley, pp. 947-978, in: Fundamental Virology, 3rd ed. Bernard N. Fields, David M. Knipe, and Peter M. Howley, eds. Lippincott-Raven Publishers, Philadelphia, 1996. The E1ORF encodes a 68-76 kD protein essential for plasmid DNA replication. The full-length E1 product is a phosphorylated nuclear protein that binds to the origin of replication in the LCR of BPV1. E1 has also been shown to bind ATP and to bind in vitro to the full length E2 protein called the E2 transcription transactivator (E2TA), thereby enhancing viral transcription. Binding to E2 also strengthens the affinity of E1 for the origin of DNA replication. In HPV-16, E1 has indirect effects on immortalization.

E6 is a small basic cell-transforming protein (e.g., the HPV16 E6 comprises 151 amino acids), about 16-19 kD, which is localized to the nuclear matrix and non-nuclear membrane fraction. The E6 gene product contains four Cys-X-X-Cys motifs, indicating a potential for zinc binding; it may also act as a nucleic acid binding protein. In high-risk HPVs such as HPV-16, E6 and E7 proteins are necessary and sufficient to immortalize their hosts-squamous epithelial cells. The E6 gene products of high-risk HPVs have been shown to complex with p53, and to promote its degradation.

The following detailed description discloses how to make and use the dsRNA and compositions containing dsRNA to inhibit the expression of the HPV Target genes, as well as compositions and methods for treating diseases and disorders caused by HPV infection, e.g. cervical cancer and genital warts. The pharmaceutical compositions of the invention comprise a dsRNA having an antisense strand comprising a region of complementarity which is less than 30 nucleotides in length, generally 19-24 nucleotides in length, and is substantially complementary to at least part of an RNA transcript of an HPV Target gene, together with a pharmaceutically acceptable carrier. An embodiment of the invention is the employment of more than one dsRNA, optionally targeting different HPV Target genes, in combination in a pharmaceutical formulation.

Accordingly, certain aspects of the invention provide pharmaceutical compositions comprising the dsRNA of the invention together with a pharmaceutically acceptable carrier, methods of using the compositions to inhibit expression of one or more HPV Target genes, and methods of using the pharmaceutical compositions to treat diseases caused by HPV infection.

I. Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A" and "U" each generally stand for a nucleotide that contains guanine, cytosine, adenine, and uracil as a base, respectively. However, it will be understood that the term "ribonucleotide" or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

As used herein, "E6AP" refers to the ubiquitin protein ligase E3A (ube3A, also referred to as E6-associated protein or E6AP) gene or protein. Human mRNA sequences to E6AP representing different isoforms are provided as GenBank Accession numbers NM_130838.1, NM_130839.1, and NM_000462.2.

As used herein, "E1" refers to the human papillomavirus type 16 (HPV16) E1 gene (GenBank accession number NC_001526, nucleotides 865 to 2813). As used herein, "E6" refers to the human papillomavirus type 16 (HPV16) E6 gene (GenBank accession number NC_001526, nucleotides 65 to 559). Many variants of the E1 and E6 genes have also been publicly disclosed. These and future published E1 and E6 gene variants are intended to be covered herein by the use of "E1" and "E6", unless specifically excluded by the context.

As used herein, "target sequence" refers to a contiguous portion of the nucleotide sequence of an mRNA molecule formed during the transcription of one of the HPV Target genes, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligo nucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide comprising the first nucleotide sequence to the oligonucleotide or polynucleotide comprising the second nucleotide sequence over the entire length of the first and second nucleotide sequence. Such sequences can be referred to as "fully complementary" with respect to each other herein. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled.

The terms "complementary", "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide which is "substantially complementary to at least part of" a messenger RNA (mRNA) refers to a polynucleotide which is substantially complementary to a contiguous portion of the mRNA of interest (e.g., encoding E6AP). For example, a polynucleotide is complementary to at least a part of a E6AP mRNA if the sequence is substantially complementary to a non-interrupted portion of a mRNA encoding E6AP.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to in the literature as siRNA ("short interfering RNA"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used in this specification, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA type molecule, are encompassed by "dsRNA" for the purposes of this specification and claims.

As used herein, a "nucleotide overhang" refers to the unpaired nucleotide or nucleotides that protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt ended" dsRNA is a dsRNA that is double-stranded over its entire length, i.e., no nucleotide overhang at either end of the molecule. For clarity, chemical caps or non-nucleotide chemical moieties conjugated to the 3' end or 5' end of an siRNA are not considered in determining whether an siRNA has an overhang or is blunt ended.

The term "antisense strand" refers to the strand of a dsRNA which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

"Introducing into a cell", when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell", wherein the cell is part of a living organism. In such instance, introduction into the cell will include the delivery to the organism. For example, for in vivo delivery, dsRNA can be injected into a tissue site or administered systemically. In vitro introduction into a cell includes methods known in the art such as electroporation and lipofection.

The terms "silence" and "inhibit the expression of", in as far as they refer to the HPV Target gene, herein refer to the at least partial suppression of the expression of the HPV Target gene, as manifested by a reduction of the amount of mRNA transcribed from the HPV Target gene which may be isolated from a first cell or group of cells in which the HPV Target gene is transcribed and which has or have been treated such that the expression of the HPV Target gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to the HPV Target gene transcription, e.g. the amount of protein encoded by the HPV Target gene which is secreted by a cell, or the number of cells displaying a certain phenotype, e.g., apoptosis. In principle, HPV Target gene silencing may be determined in any cell expressing the target, either constitutively or by genomic engineering, and by any appropriate assay. However, when a reference is needed in order to determine whether a given dsRNA inhibits the expression of the HPV Target gene by a certain degree and therefore is encompassed by the instant invention, the assay provided in the Examples below shall serve as such reference.

For example, in certain instances, expression of the E6AP gene is suppressed by at least about 20%, 25%, 35%, or 50% by administration of the double-stranded oligonucleotide of the invention. In some embodiments, the E6AP gene is suppressed by at least about 60%, 70%, or 80% by administration of the double-stranded oligonucleotide of the invention. In some embodiments, the E6AP gene is suppressed by at least about 85%, 90%, or 95% by administration of the double-stranded oligonucleotide of the invention. Table 2 provides a wide range of values for inhibition of transcription obtained in an in vitro assay using various E6AP dsRNA molecules at various concentrations. Likewise, Table 6 provides a wide range of values for the inhibition of transcription of E1; and Table 8 provides a wide range of values for the inhibition of transcription of E6.

As used herein in the context of HPV infection, the terms "treat", "treatment", and the like, refer to relief from or alleviation of pathological processes mediated by HPV infection. Such description includes use of the therapeutic agents of the invention for prophylaxis or prevention of HPV infection, and relief from symptoms or pathologies caused by HPV infection. In the context of the present invention insofar as it relates to any of the other conditions recited herein below (other than pathological processes mediated by HPV infection), the terms "treat", "treatment", and the like mean to relieve or alleviate at least one symptom associated with such condition, or to slow or reverse the progression of such condition.

As used herein, the phrases "therapeutically effective amount" and "prophylactically effective amount" refer to an amount that provides a therapeutic benefit in the treatment, prevention, or management of pathological processes mediated by HPV infection or an overt symptom of pathological processes mediated by HPV infection. The specific amount that is therapeutically effective can be readily determined by ordinary medical practitioner, and may vary depending on factors known in the art, such as, e.g. the type of pathological processes mediated by HPV infection, the patient's history and age, the stage of pathological processes mediated by HPV infection, and the administration of other anti-pathological agents.

As used herein, a "pharmaceutical composition" comprises a pharmacologically effective amount of a dsRNA and a pharmaceutically acceptable carrier. As used herein, "pharmacologically effective amount," "therapeutically effective amount" or simply "effective amount" refers to that amount of a dsRNA effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract.

As used herein, a "transformed cell" is a cell into which a vector has been introduced from which a dsRNA molecule may be expressed.

II. Double-Stranded Ribonucleic Acid (dsRNA)

In one embodiment, the invention provides double-stranded ribonucleic acid (dsRNA) molecules for inhibiting the expression of the HPV Target gene in a cell or mammal, wherein the dsRNA comprises an antisense strand comprising a region of complementarity which is complementary to at least a part of an mRNA formed in the expression of the HPV Target gene, and wherein the region of complementarity is less than 30 nucleotides in length, generally 19-24 nucleotides in length, and wherein said dsRNA, upon contact with a cell expressing said HPV Target gene, inhibits the expression of said HPV Target gene by at least 10%, 25%, or 40%.

The dsRNA comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the HPV Target gene, the other strand (the sense strand) comprises a region which is complementary to the antisense strand; such that the two strands hybridize and form a duplex structure when combined under suitable conditions. Generally, the duplex structure is between 15 and 30, more generally between 18 and 25, yet more generally between 19 and 24, and most generally between 19 and 21 base pairs in length. Similarly, the region of complementarity to the target sequence is between 15 and 30, more generally between 18 and 25, yet more generally between 19 and 24, and most generally between 19 and 21 nucleotides in length. The dsRNA of the invention may further comprise one or more single-stranded nucleotide overhang(s). The dsRNA can be synthesized by standard methods known in the art as further discussed below, e.g., by use of an automated DNA synthesizer, such as are commercially available from, for example, Biosearch, Applied Biosystems, Inc. In a preferred embodiment, the HPV Target gene is the human E6AP gene. In specific embodiments, the antisense strand of the dsRNA comprises a strand selected from the sense sequences of Table 1 and a second sequence selected from the group consisting of the antisense sequences of Table 1. Alternative antisense agents that target elsewhere in the target sequence provided in Table 1 can readily be determined using the target sequence and the flanking E6AP sequence.

In further embodiments, the dsRNA comprises at least one nucleotide sequence selected from the groups of sequences provided in Table 1. In other embodiments, the dsRNA comprises at least two sequences selected from this group, wherein one of the at least two sequences is complementary to another of the at least two sequences, and one of the at least two sequences is substantially complementary to a sequence of an mRNA generated in the expression of the E6AP gene. Generally, the dsRNA comprises two oligonucleotides, wherein one oligonucleotide is described as the sense strand in Table 1 and the second oligonucleotide is described as the antisense strand in Table 1. Table 1 provides a duplex name and sequence ID number for each preferred dsRNA.

In further embodiments, the dsRNA comprises at least one named duplex dsRNA selected from the groups of sequences provided in Table 5 (E1 dsRNA) or Table 7 (E6 dsRNA).

The skilled person is well aware that dsRNAs comprising a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well. In the embodiments described above, by virtue of the nature of the oligonucleotide sequences provided in Table 1, Table 5 or Table 7, the dsRNAs of the invention can comprise at least one strand of a length of minimally 21 nt. It can be reasonably-expected that shorter dsRNAs comprising one of the sequences of Table 1, Table 5 or Table 7, minus only a few nucleotides on one or both ends may be similarly effective as compared to the dsRNAs described above. Hence, dsRNAs comprising a partial sequence of at least 15, 16, 17, 18, 19, 20, or more contiguous nucleotides from one of the sequences of Table 1, Table 5 or Table 7, and differing in their ability to inhibit the expression of the HPV Target gene in a FACS assay or other assay as described herein below by not more than 5, 10, 15, 20, 25, or 30% inhibition from a dsRNA comprising the full sequence, are contemplated by the invention. Further dsRNAs that cleave within the target sequence provided in Table 1, Table 5 or Table 7 can readily be made using the reference sequence and the target sequence provided.

In addition, the RNAi agents provided in Table 1, Table 5 and Table 7 identify a site in the respective HPV Target mRNA that is susceptible to RNAi based cleavage. As such the present invention further includes RNAi agents that target within the sequence targeted by one of the agents of the present invention. As used herein a second RNAi agent is said to target within the sequence of a first RNAi agent if the second RNAi agent cleaves the message anywhere within the mRNA that is complementary to the antisense strand of the first RNAi agent. Such a second agent will generally consist of at least 15 contiguous nucleotides from one of the sequences provided in Table 1, Table 5 or Table 7 coupled to additional nucleotide sequences taken from the region contiguous to the selected sequence in the HPV Target gene. For example, the last 15 nucleotides of SEQ ID NO: 1 (minus the added AA sequences) combined with the next 6 nucleotides from the target E6AP gene produces a single strand agent of 21 nucleotides that is based on one of the sequences provided in Table 1.

The dsRNA of the invention can contain one or more mismatches to the target sequence. In a preferred embodiment, the dsRNA of the invention contains no more than 3 mismatches. If the antisense strand of the dsRNA contains mismatches to a target sequence, it is preferable that the area of mismatch not be located in the center of the region of complementarity. If the antisense strand of the dsRNA contains mismatches to the target sequence, it is preferable that the mismatch be restricted to 5 nucleotides from either end, for example 5, 4, 3, 2, or 1 nucleotide from either the 5' or 3' end of the region of complementarity. For example, for a 23 nucleotide dsRNA strand which is complementary to a region of the HPV Target gene, the dsRNA generally does not contain any mismatch within the central 13 nucleotides. The methods described within the invention can be used to determine whether a dsRNA containing a mismatch to a target sequence is effective in inhibiting the expression of the HPV Target gene. Consideration of the efficacy of dsRNAs with mismatches in inhibiting expression of the HPV Target gene is important, especially if the particular region of complementarity in the HPV Target gene is known to have polymorphic sequence variation in the virus (if E1 or E6) or within the human population (for E6AP).

In one embodiment, at least one end of the dsRNA has a single-stranded nucleotide overhang of 1 to 4, generally 1 or 2 nucleotides. dsRNAs having at least one nucleotide overhang have unexpectedly superior inhibitory properties than their blunt-ended counterparts. Moreover, the present inventors have discovered that the presence of only one nucleotide overhang strengthens the interference activity of the dsRNA, without affecting its overall stability. dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA may also have a blunt end, generally located at the 5'-end of the antisense strand. Such dsRNAs have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

In yet another embodiment, the dsRNA is chemically modified to enhance stability. The nucleic acids of the invention may be synthesized and/or modified by methods well established in the art, such as those described in "Current protocols in nucleic acid chemistry", Beaucage, S. L. et al. (Edrs.), John Wiley & Sons, Inc., New York, N.Y., USA, which is hereby incorporated herein by reference. Chemical modifications may include, but are not limited to 2' modifications, modifications at other sites of the sugar or base of an oligonucleotide, introduction of non-natural bases into the oligonucleotide chain, covalent attachment to a ligand or chemical moiety, and replacement of internucleotide phosphate linkages with alternate linkages such as thiophosphates. More than one such modification may be employed.

Chemical linking of the two separate dsRNA strands may be achieved by any of a variety of well-known techniques, for example by introducing covalent, ionic or hydrogen bonds; hydrophobic interactions, van der Waals or stacking interactions; by means of metal-ion coordination, or through use of purine analogues. Generally, the chemical groups that can be used to modify the dsRNA include, without limitation, methylene blue; bifunctional groups, generally bis-(2-chloroethyl) amine; N-acetyl-N'-(p-glyoxylbenzoyl)cystamine; 4-thiouracil; and psoralen. In one embodiment, the linker is a hexaethylene glycol linker. In this case, the dsRNA are produced by solid phase synthesis and the hexaethylene glycol linker is incorporated according to standard methods (e.g., Williams, D. J., and K. B. Hall, *Biochem.* (1996) 35:14665-14670). In a particular embodiment, the 5'-end of the antisense strand and the 3'-end of the sense strand are chemically linked via a hexaethylene glycol linker. In another embodiment, at least one nucleotide of the dsRNA comprises a phosphorothioate or phosphorodithioate groups. The chemical bond at the ends of the dsRNA is generally formed by triple-helix bonds. Table 1 provides examples of modified RNAi agents of the invention.

In yet another embodiment, the nucleotides at one or both of the two single strands may be modified to prevent or inhibit the degradation activities of cellular enzymes, such as, for example, without limitation, certain nucleases. Techniques for inhibiting the degradation activity of cellular enzymes against nucleic acids are known in the art including, but not limited to, 2'-amino modifications, 2'-amino sugar modifications, 2'-F sugar modifications, 2'-F modifications, 2'-alkyl sugar modifications, uncharged backbone modifications, morpholino modifications, 2'-O-methyl modifications, and phosphoramidate (see, e.g., Wagner, *Nat. Med.* (1995) 1:1116-8). Thus, at least one 2'-hydroxyl group of the nucleotides on a dsRNA is replaced by a chemical group, generally by a 2'-amino or a 2'-methyl group. Also, at least one nucleotide may be modified to form a locked nucleotide. Such locked nucleotide contains a methylene bridge that connects the 2'-oxygen of ribose with the 4'-carbon of ribose. Oligonucleotides containing the locked nucleotide are described in Koshkin, A. A., et al., *Tetrahedron* (1998), 54: 3607-3630) and Obika, S. et al., *Tetrahedron Lett.* (1998), 39: 5401-5404). Introduction of a locked nucleotide into an oligonucleotide improves the affinity for complementary sequences and increases the melting temperature by several degrees (Braasch, D. A. and D. R. Corey, *Chem. Biol.* (2001), 8:1-7).

Conjugating a ligand to a dsRNA can enhance its cellular absorption as well as targeting to a particular tissue or uptake by specific types of cells such as vaginal epithelium. In certain instances, a hydrophobic ligand is conjugated to the dsRNA to facilitate direct permeation of the cellular membrane. Alternatively, the ligand conjugated to the dsRNA is a substrate for receptor-mediated endocytosis. These approaches have been used to facilitate cell permeation of antisense oligonucleotides as well as dsRNA agents. For example, cholesterol has been conjugated to various antisense oligonucleotides resulting in compounds that are substantially more active compared to their non-conjugated analogs. See. M. Manoharan *Antisense & Nucleic Acid Drug Development* 2002, 12, 103. Other lipophilic compounds that have been conjugated to oligonucleotides include 1-pyrene butyric acid, 1,3-bis-O-(hexadecyl)glycerol, and menthol. One example of a ligand for receptor-mediated endocytosis is folic acid. Folic acid enters the cell by folate-receptor-mediated endocytosis. dsRNA compounds bearing folic acid would be efficiently transported into the cell via the folate-receptor-mediated endocytosis. Li and coworkers report that attachment of folic acid to the 3'-terminus of an oligonucleotide resulted in an 8-fold increase in cellular uptake of the oligonucleotide. Li, S.; Deshmukh, H. M.; Huang, L. *Pharm. Res.* 1998, 15, 1540. Other ligands that have been conjugated to oligonucleotides include polyethylene glycols, carbohydrate clusters, cross-linking agents, porphyrin conjugates, and delivery peptides.

In certain instances, conjugation of a cationic ligand to oligonucleotides results in improved resistance to nucleases. Representative examples of cationic ligands are propylammonium and dimethylpropylammonium. Interestingly, antisense oligonucleotides were reported to retain their high binding affinity to mRNA when the cationic ligand was dispersed throughout the oligonucleotide. See M. Manoharan *Antisense & Nucleic Acid Drug Development* 2002, 12, 103 and references therein.

The ligand-conjugated dsRNA of the invention may be synthesized by the use of a dsRNA that bears a pendant reactive functionality, such as that derived from the attachment of a linking molecule onto the dsRNA. This reactive oligonucleotide may be reacted directly with commercially-available ligands, ligands that are synthesized bearing any of a variety of protecting groups, or ligands that have a linking moiety attached thereto. The methods of the invention facilitate the synthesis of ligand-conjugated dsRNA by the use of, in some preferred embodiments, nucleoside monomers that have been appropriately conjugated with ligands and that may further be attached to a solid-support material. Such ligand-nucleoside conjugates, optionally attached to a solid-support material, are prepared according to some preferred embodiments of the methods of the invention via reaction of a selected serum-binding ligand with a linking moiety located on the 5' position of a nucleoside or oligonucleotide. In certain instances, an dsRNA bearing an aralkyl ligand attached to the 3'-terminus of the dsRNA is prepared by first covalently attaching a monomer building block to a controlled-pore-glass support via a long-chain aminoalkyl group. Then, nucleotides are bonded via standard solid-phase synthesis techniques to the monomer building-block bound to the solid support. The monomer building block may be a nucleoside or other organic compound that is compatible with solid-phase synthesis.

The dsRNA used in the conjugates of the invention may be conveniently and routinely made through the well-known technique of solid-phase synthesis. Equipment for such synthesis is sold by several vendors including, for example, Applied Biosystems. (Foster City, Calif.). Any other means for such synthesis known in the art may additionally or alternatively be employed. It is also known to use similar techniques to prepare other oligonucleotides, such as the phosphorothioates and alkylated derivatives.

Teachings regarding the synthesis of particular modified oligonucleotides may be found in the following U.S. Pat. Nos. 5,138,045 and 5,218,105, drawn to polyamine conjugated oligonucleotides; U.S. Pat. No. 5,212,295, drawn to monomers for the preparation of oligonucleotides having chiral phosphorus linkages; U.S. Pat. Nos. 5,378,825 and 5,541,307, drawn to oligonucleotides having modified backbones; U.S. Pat. No. 5,386,023, drawn to backbone-modified oligonucleotides and the preparation thereof through reductive coupling; U.S. Pat. No. 5,457,191, drawn to modified nucleobases based on the 3-deazapurine ring system and methods of synthesis thereof; U.S. Pat. No. 5,459,255, drawn to modified nucleobases based on N-2 substituted purines; U.S. Pat. No. 5,521,302, drawn to processes for preparing oligonucleotides having chiral phosphorus linkages; U.S. Pat. No. 5,539,082, drawn to peptide nucleic acids; U.S. Pat. No. 5,554,746, drawn to oligonucleotides having β-lactam backbones; U.S.

Pat. No. 5,571,902, drawn to methods and materials for the synthesis of oligonucleotides; U.S. Pat. No. 5,578,718, drawn to nucleosides having alkylthio groups, wherein such groups may be used as linkers to other moieties attached at any of a variety of positions of the nucleoside; U.S. Pat. Nos. 5,587,361 and 5,599,797, drawn to oligonucleotides having phosphorothioate linkages of high chiral purity; U.S. Pat. No. 5,506,351, drawn to processes for the preparation of 2'-O-alkyl guanosine and related compounds, including 2,6-diaminopurine compounds; U.S. Pat. No. 5,587,469, drawn to oligonucleotides having N-2 substituted purines; U.S. Pat. No. 5,587,470, drawn to oligonucleotides having 3-deazapurines; U.S. Pat. No. 5,223,168, and U.S. Pat. No. 5,608,046, both drawn to conjugated 4'-desmethyl nucleoside analogs; U.S. Pat. Nos. 5,602,240, and 5,610,289, drawn to backbone-modified oligonucleotide analogs; U.S. Pat. Nos. 6,262,241, and 5,459,255, drawn to, inter alia, methods of synthesizing 2'-fluoro-oligonucleotides.

In the ligand-conjugated dsRNA and ligand-molecule bearing sequence-specific linked nucleosides of the invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. Oligonucleotide conjugates bearing a variety of molecules such as steroids, vitamins, lipids and reporter molecules, has previously been described (see Manoharan et al., PCT Application WO 93/07883). In a preferred embodiment, the oligonucleotides or linked nucleosides of the invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

The incorporation of a 2'-O-methyl, 2'-O-ethyl, 2'-O-propyl, 2'-O-allyl, 2'-O-aminoalkyl or 2'-deoxy-2'-fluoro group in nucleosides of an oligonucleotide confers enhanced hybridization properties to the oligonucleotide. Further, oligonucleotides containing phosphorothioate, backbones have enhanced nuclease stability. Thus, functionalized, linked nucleosides of the invention can be augmented to include either or both a phosphorothioate backbone or a 2'-O-methyl, 2'-O-ethyl, 2'-O-propyl, 2'-O-aminoalkyl, 2'-O-allyl or 2'-deoxy-2'-fluoro group. A summary listing of some of the oligonucleotide modifications known in the art is found at, for example, PCT Publication WO 200370918.

In some embodiments, functionalized nucleoside sequences of the invention possessing an amino group at the 5'-terminus are prepared using a DNA synthesizer, and then reacted with an active ester derivative of a selected ligand. Active ester derivatives are well known to those skilled in the art. Representative active esters include N-hydrosuccinimide esters, tetrafluorophenolic esters, pentafluorophenolic esters and pentachlorophenolic esters. The reaction of the amino group and the active ester produces an oligonucleotide in which the selected ligand is attached to the 5'-position through a linking group. The amino group at the 5'-terminus can be prepared utilizing a 5'-Amino-Modifier C6 reagent. In one embodiment, ligand molecules may be conjugated to oligonucleotides at the 5'-position by the use of a ligand-nucleoside phosphoramidite wherein the ligand is linked to the 5'-hydroxy group directly or indirectly via a linker. Such ligand-nucleoside phosphoramidites are typically used at the end of an automated synthesis procedure to provide a ligand-conjugated oligonucleotide bearing the ligand at the 5'-terminus.

Examples of modified internucleoside linkages or backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free-acid forms are also included.

Representative United States patents relating to the preparation of the above phosphorus-atom-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; 5,625,050; and 5,697,248, each of which is herein incorporated by reference.

Examples of modified internucleoside linkages or backbones that do not include a phosphorus atom therein (i.e., oligonucleosides) have backbones that are formed by short chain alkyl or cycloalkyl intersugar linkages, mixed heteroatom and alkyl or cycloalkyl intersugar linkages, or one or more short chain heteroatomic or heterocyclic intersugar linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative United States patents relating to the preparation of the above oligonucleosides include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

In certain instances, the oligonucleotide may be modified by a non-ligand group. A number of non-ligand molecules have been conjugated to oligonucleotides in order to enhance the activity, cellular distribution or cellular uptake of the oligonucleotide, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-5-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochem. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such oligonucleotide conjugates have been listed above. Typical conjugation protocols involve the synthesis of oligonucleotides bearing an aminolinker at one or more positions of the sequence. The amino group is then reacted with the molecule being conjugated using appropriate coupling or activating reagents. The conjugation reaction may be performed either with the oligonucleotide still bound to the solid support or following cleavage of the oligonucleotide in solution phase. Purification of the oligonucleotide conjugate by HPLC typically affords the pure conjugate. The use of a cholesterol conjugate is particularly preferred since such a moiety can increase targeting vaginal epithelium cells, a site of HPV infection.

The instant disclosure describes a wide variety of embodiments of dsRNA that are useful to silence HPV Target genes and thus to treat HPV associated disorders. While the design of the specific therapeutic agent can take a variety of forms, certain functional characteristics will distinguish preferred dsRNA from other dsRNA. In particular, features such as good serum stability, high potency, lack of induced immune response, and good drug like behaviour, all measurable by those skilled in the art, will be tested to identify preferred dsRNA of the invention. In some situations, not all of these functional aspects will be present in the preferred dsRNA. But those skilled in the art are able to optimize these variables and others to select preferred compounds of the invention.

While many nucleotide modifications are possible, the inventors have identified patterns of chemical modifications which provide significantly improved pharmacological, immunological and ultimately therapeutic benefit. Table 9 sets out patterns of chemical modifications preferred for use with the duplex dsRNA set out in Table 1, Table 5 and Table 7 of the invention. Some of these modifications are also illustrated in Table 3.

TABLE 9

| Chemical Modification Series | Changes made to sense strand (5'-3') | Changes made to antisense stand (5'-3') |
| --- | --- | --- |
| 1 (single phosphorothioate at the ends of both strands) | dTsdT | dTsdT |
| 2 (single phosphorothioate at the ends of both strands plus, 2'OMe sense strand modification of all pyrimidines and 2'Ome modification of all U's followed by and A and all C's followed by A) | dTsdT, 2'OMe@all Py | dTsdT, 2'OMe@uA, cA |
| 3 (single phosphorothioate at the ends of both strands plus, 2'OMe sense strand modification of all pyrimidines and, 2'Ome of indicted bases all U's followed by an A, all C's followed by an A, all U's followed by a G and all U's followed by a U on the antisense strand) | dTsdT, 2'OMe@all Py | dTsdT, 2'OMe@uA, cA, uG, uU |
| 4 (same as 1 except addition of cholesterol conjugated to the sense strand) | Chol ("exo") | dTsdT ("exo") |
| 5 (same as 2 except cholesterol conjugated to the sense strand) | Chol ("endo") | dTsdT, 2'OMe@uA, cA |
| 6 (same as 3 except cholesterol conjugated to the sense strand) | Chol ("endo") | dTsdT, 2'OMe@uA, cA, uG, uU |

Vector Encoded RNAi Agents

The dsRNA of the invention can also be expressed from recombinant viral vectors intracellularly in vivo. The recombinant viral vectors of the invention comprise sequences encoding the dsRNA of the invention and any suitable promoter for expressing the dsRNA sequences. Suitable promoters include, for example, the U6 or H1 RNA pol III promoter sequences and the cytomegalovirus promoter. Selection of other suitable promoters is within the skill in the art. The recombinant viral vectors of the invention can also comprise inducible or regulatable promoters for expression of the dsRNA in a particular tissue or in a particular intracellular environment. The use of recombinant viral vectors to deliver dsRNA of the invention to cells in vivo is discussed in more detail below.

dsRNA of the invention can be expressed from a recombinant viral vector either as two separate, complementary RNA molecules, or as a single RNA molecule with two complementary regions.

Any viral vector capable of accepting the coding sequences for the dsRNA molecule(s) to be expressed can be used, for example vectors derived from adenovirus (AV); adeno-associated virus (AAV); retroviruses (e.g, lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors of the invention can be pseudotyped with surface proteins from vesicular stomatitis virus (VSV), rabies, Ebola, Mokola, and the like. AAV vectors of the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), J Virol 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), Gene Therap. 2: 301-310; Eglitis M A (1988), Biotechniques 6: 608-614; Miller A D (1990), Hum Gene Therap. 1: 5-14; Anderson W F (1998), Nature 392: 25-30; and Rubinson D A et al., Nat. Genet. 33: 401-406, the entire disclosures of which are herein incorporated by reference.

Preferred viral vectors are those derived from AV and AAV. In a particularly preferred embodiment, the dsRNA of the invention is expressed as two separate, complementary single-stranded RNA molecules from a recombinant AAV vector comprising, for example, either the U6 or H1 RNA promoters, or the cytomegalovirus (CMV) promoter.

A suitable AV vector for expressing the dsRNA of the invention, a method for constructing the recombinant AV vector, and a method for delivering the vector into target cells, are described in Xia H et al. (2002), Nat. Biotech. 20: 1006-1010.

Suitable AAV vectors for expressing the dsRNA of the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

III. Pharmaceutical Compositions Comprising dsRNA

In one embodiment, the invention provides pharmaceutical compositions comprising a dsRNA, as described herein, and a pharmaceutically acceptable carrier. The pharmaceutical composition comprising the dsRNA is useful for treating a disease or disorder associated with the expression or activity of the HPV Target gene, such as pathological processes mediated by HPV infection. Such pharmaceutical compositions are formulated based on the mode of delivery. One example is compositions that are formulated for either topical administration in the cervix or systemic administration via parenteral delivery.

The pharmaceutical compositions of the invention are administered in dosages sufficient to inhibit expression of the HPV Target gene. The present inventors have determined that, because of their improved efficiency, compositions comprising the dsRNA of the invention can be administered at surprisingly low dosages. A dosage of 5 mg dsRNA per kilogram body weight of recipient per day is sufficient to inhibit or suppress expression of the HPV Target gene, and in the case of warts or cervical or anal treatment, may be applied directly to the infected tissue.

In general, a suitable dose of dsRNA will be in the range of 0.01 to 5.0 milligrams per kilogram body weight of the recipient per day, generally in the range of 1 microgram to 1 mg per kilogram body weight per day. The pharmaceutical composition may be administered once daily, or the dsRNA may be administered as two, three, or more sub-doses at appropriate intervals throughout the day or even using continuous infusion or delivery through a controlled release formulation of vaginal gel. In that case, the dsRNA contained in each sub-dose must be correspondingly smaller in order to achieve the total daily dosage. The dosage unit can also be compounded for delivery over several days, e.g., using a conventional sustained release formulation which provides sustained release of the dsRNA over a several day period. Sustained release formulations are well known in the art and are particularly useful for vaginal delivery of agents, such as could be used with the agents of the present invention. In this embodiment, the dosage unit contains a corresponding multiple of the daily dose.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

The inventors recognize that for a variety of reasons, including the variability of HPV genotypes, it may be desirable to treat HPV infection with more than one dsRNA of the invention at the same time. In an embodiment, a combination of dsRNA are selected to target the widest range of HPV genotypes, with the least complex mixture of dsRNA. A pharmaceutical composition of the invention comprising more than one type of dsRNA would be expected to contain dosages of individual dsRNA as described herein.

Combinations of dsRNA may be provided together in a single dosage form pharmaceutical composition. Alternatively, combination dsRNA may be provided in separate dosage forms, in which case they may be administered at the same time or at different times, and possibly by different means. The invention therefore contemplates pharmaceutical compositions comprising the desired combinations of dsRNA of the invention; and it also contemplates pharmaceutical compositions of single dsRNA which are intended to be provided as part of a combination regimen. In this latter case, the combination therapy invention is thereby a method of administering rather than a composition of matter.

Advances in mouse genetics have generated a number of mouse models for the study of various human diseases, such as pathological processes mediated by HPV infection. Such models are used for in vivo testing of dsRNA, as well as for determining a therapeutically effective dose.

Any method can be used to administer a dsRNA of the present invention to a mammal containing cells infected with HPV. For example, administration can be topical (e.g., vaginal, transdermal, etc); oral; or parenteral (e.g., by subcutaneous, intraventricular, intramuscular, or intraperitoneal injection, or by intravenous drip). Administration can be rapid (e.g., by injection), or can occur over a period of time (e.g., by slow infusion or administration of slow release formulations).

Typically, when treating a mammal having cells infected with HPV, the dsRNA molecules are administered topically in a vaginal gel or cream. For example, dsRNAs formulated with or without liposomes can be topically applied directly to the cervix, anal tract or HPV lesions such as genital warts. For topical administration, a dsRNA molecule can be formulated into compositions such as sterile and non-sterile aqueous solutions, non-aqueous solutions in common solvents such as alcohols, or solutions in liquid or solid oil bases. Such solutions also can contain buffers, diluents, and other suitable additives. Compositions for topical administration can be formulated in the form of transdermal patches, ointments, lotions, creams, gels, drops, suppositories, sprays, liquids, and powders. Gels and creams may be formulated using polymers and permeabilizers known in the art. Gels or creams containing the dsRNA and associated excipients may be applied to the cervix using a cervical cap, vaginal diaphragm, coated condom, glove, and the like. Conventional pharmaceutical carriers, aqueous, powder or oily bases, thickeners, and the like can be added.

For parenteral, intrathecal, or intraventricular administration, a dsRNA molecule can be formulated into compositions such as sterile aqueous solutions, which also can contain buffers, diluents, and other suitable additives (e.g., penetration enhancers, carrier compounds, and other pharmaceutically acceptable carriers).

In addition, dsRNA molecules can be administered to a mammal containing HPV-infected cells using non-viral methods, such as biologic or a biologic means as described in, for example, U.S. Pat. No. 6,271,359. A biologic delivery can be accomplished by a variety of methods including, without limitation, (1) loading liposomes with a dsRNA acid molecule provided herein and (2) complexing a dsRNA molecule with lipids or liposomes to form nucleic acid-lipid or nucleic acid-liposome complexes. The liposome can be composed of cationic and neutral lipids commonly used to transfect cells in vitro. Cationic lipids can complex (e.g., charge-associate) with negatively charged nucleic acids to form liposomes. Examples of cationic liposomes include, without limitation, lipofectin, lipofectamine, lipofectace, DOTAP (1,2-dioleoyl-3-trimethylammonium propane), DOTMA (N-[1,2(2,3-dioleyloxy)propyl]-N,N,N-trimethylammonium chloride), DOSPA (2,3-dioleoyloxy-N-[2-(sperminecarboxamido)ethyl]-N,N-deimethyl-1-propanaminium), DOGS (dioctadecyl amido glycil spermine), and DC-chol (3,[N—$N^1$,N-dimethylethylenediamine)-carbamoyl]cholesterol).

Procedures for forming liposomes are well known in the art. Liposome compositions can be formed, for example, from phosphatidylcholine, dimyristoyl phosphatidylcholine, dipalmitoyl phosphatidylcholine, dimyristoyl phosphatidylglycerol, or dioleoyl phosphatidylethanolamine. Numerous lipophilic agents are commercially available, including Lipofectin.RTM. (Invitrogen/Life Technologies, Carlsbad, Calif.) and Effectene.TM. (Qiagen, Valencia, Calif.). In addition, systemic delivery methods can be optimized using commercially available cationic lipids such as DDAB or DOTAP, each of which can be mixed with a neutral lipid such as DOPE or cholesterol. In some cases, liposomes such as those described by Templeton et al. (Nature Biotechnology, 15: 647-652 (1997)) can be used. In other embodiments, polycations such as polyethyleneimine can be used to achieve delivery in vivo and ex vivo (Boletta et al., J. Am. Soc. Nephrol. 7: 1728 (1996)). Additional information regarding the use of liposomes to deliver nucleic acids can be found in U.S. Pat. No. 6,271,359, PCT Publication WO 96/40964 and Morrissey, D. et al. 2005. Nat Biotechnol. 23(8): 1002-7.

Other non-viral methods of administering dsRNA molecules to a mammal containing HPV-infected cells include cationic lipid-based delivery systems (in addition to liposomes) such as lipoplexes and nanoemulsions. Additionally, condensing polymeric delivery systems (i.e., DNA-polymer complexes, or "polyplexes") may be used, including but not limited to chitosans, poly(L-lysine) (PLL), polyethylenimine (PEI), dendrimers (e.g., polyamidoamine (PANAM) dendrimers), and poloxamines. Additionally, noncondensing polymeric delivery systems may be used, including but not limited to poloxamers, gelatin, PLGA (polylactic-co-glycolic acid), PVP (polyvinylpyrrolidone), and PVA (polyvinyl alcohol).

Procedures for the above-mentioned delivery or administration techniques are well known in the art. For instance, condensing polymeric delivery systems work by easily complexing with anionic DNA molecules; for example, poly(L-lysine)(PLL) works by forming a positively charged complex that interacts with negatively charged cell surface and subsequently undergoing rapid internalization.

Biologic delivery can be accomplished by a variety of methods including, without limitation, the use of viral vectors. For example, viral vectors (e.g., adenovirus and herpesvirus vectors) can be used to deliver dsRNA molecules to skin cells and cervical cells. Standard molecular biology techniques can be used to introduce one or more of the dsRNAs provided herein into one of the many different viral vectors previously developed to deliver nucleic acid to cells. These resulting viral vectors can be used to deliver the one or more dsRNAs to cells by, for example, infection.

dsRNAs of the present invention can be formulated in a pharmaceutically acceptable carrier or diluent. A "pharmaceutically acceptable carrier" (also referred to herein as an "excipient") is a pharmaceutically acceptable solvent, suspending agent, or any other pharmacologically inert vehicle. Pharmaceutically acceptable carriers can be liquid or solid, and can be selected with the planned manner of administration in mind so as to provide for the desired bulk, consistency, and other pertinent transport and chemical properties. Typical pharmaceutically acceptable carriers include, by way of example and not limitation: water; saline solution; binding agents (e.g., polyvinylpyrrolidone or hydroxypropyl methylcellulose); fillers (e.g., lactose and other sugars, gelatin, or calcium sulfate); lubricants (e.g., starch, polyethylene glycol, or sodium acetate); disintegrates (e.g., starch or sodium starch glycolate); and wetting agents (e.g., sodium lauryl sulfate).

In addition, dsRNA that target the HPV Target gene can be formulated into compositions containing the dsRNA admixed, encapsulated, conjugated, or otherwise associated with other molecules, molecular structures, or mixtures of nucleic acids. For example, a composition containing one or more dsRNA agents that target the E6AP gene can contain other therapeutic agents such as anti-inflammatory drugs (e.g., nonsteroidal anti-inflammatory drugs and corticosteroids) and antiviral drugs (e.g., ribivirin, vidarabine, acyclovir, and ganciclovir). In some embodiments, a composition can contain one or more dsRNAs having a sequence complementary to the HPV Target gene in combination with a keratolytic agent. Keratolytic agents are agents that separate or loosen the horny layer of the epidermis. An example of a keratolytic agent includes, without limitation, salicylic acid. Other examples are provided in U.S. Pat. No. 5,543,417. Keratolytic agents can be used in an amount effective to enhance the penetration of dsRNAs, for example, into tissues such as skin. For example, a keratolytic agent can be used in an amount that allows a dsRNA applied to a genital wart to penetrate throughout the wart.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit high therapeutic indices are preferred.

The data obtained from cell culture assays and animal studies can be used in formulation a range of dosage for use in humans. The dosage of compositions of the invention lies generally within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration individually or as a plurality, as discussed above, the dsRNAs of the invention can be administered in combination with other known agents effective in treatment of pathological processes mediated by HPV infection. In any event, the administering physician can adjust the amount and timing of dsRNA administration on the basis of results observed using standard measures of efficacy known in the art or described herein.

Combinations of dsRNA can be tested in vitro and in vivo using the same methods employed for identification of preferred single dsRNA. Such combinations may be selected based on a purely bioinformatics basis, wherein the minimum number of siRNA are selected which provide coverage over the widest range of genotypes. Alternatively, such combinations may be selected based on in vitro or in vivo evaluations along the lines of those described herein for single dsRNA agents. A preferred assay for testing combinations of dsRNA is to evaluate the phenotypic consequences of siRNA mediated HPV target knockdown in HPV16 positive cancer cell lines (e.g. SiHa or Caski, as described in, e.g., Hengstermann et al. (2005) Journal Vir. 79(14): 9296; and Butz et al. (2003) Oncogene 22: 5938), or in organotypic culture systems, as described in, e.g., Jeon et al. (1995) Journal Vir. 69(5):2989.

The inventors have identified certain preferred combinations of dsRNA which may be used to treat HPV infection. In the most general terms, the combination of dsRNA comprises more than one dsRNA selected from among Table 1, Table 3, Table 5 and Table 7. Thus the invention contemplates the use of 2, 3, 4, 5 or more dsRNA duplexes selected from among Table 1, Table 3, Table 5 and Table 7 in a combination therapy. In principle, the smallest number of dsRNA is preferred for simplicity of the therapeutic product. This forces the selection of dsRNA which will cover the greatest number of deleterious or potentially deleterious HPV genotypes, and indeed may justify selection of a combination that does not necessarily cover all such HPV genotypes.

The following dsRNA are particularly amenable to combination:

From E1: ND-9072; ND-9142; ND-9092; ND-9162; ND-9097; ND-9167; ND-9066; ND-9123; AL-DP-8082; AL-DP-8095;

From E6: ND-8903; ND-8991; ND-8914; ND-9002; ND-8906; ND-8994; ND-8943; ND-9031; ND-9032; ND-8920; ND-8952; ND-8951; ND-9008; ND-9040; ND-9039; AL-DP-7783; AL-DP-7784;

From E6AP: AL-DP-7365; AL-DP-7371; AL-DP-7499; AL-DP-7545; AL-DP-7492; AL-DP-7473; AL-DP-7478; AL-DP-7554; AL-DP-7514; AL-DP-7397, ND-9300.

Methods for Treating Diseases Caused by HPV Infection

The methods and compositions described herein can be used to treat diseases and conditions caused by human papillomavirus, which can be the result of clinical or sub-clinical papillomavirus infections. Such diseases and conditions, herein sometimes called "HPV associated disorders" or "pathological processes mediated by HPV infection", include, e.g., epithelial malignancies, skin cancer (non-melanoma or melanoma), anogenital malignancies such as cervical cancer, HPV associated precancerous lesions (including LSIL or HSIL cervical tissue), anal carcinoma, malignant lesions, benign lesions, papillomacarcinomas, papilloadenocystomas, papilloma neuropathicum, papillomatosis, cutaneous and mucosal papillomas, condylomas, fibroblastic tumors, and other pathological conditions associated with papillomavirus.

For example, the compositions described herein can be used to treat warts caused by HPV. Such warts include, e.g., common warts (verruca vulgaris), for example, palmar, plantar, and periungual warts; flat and filiform warts; anal, oral, pharyngeal, laryngeal, and tongue papillomas; and venereal warts (condyloma accuminata), also known as genital warts (for example, penile, vulvar, vaginal and cervical warts), which are one of the most serious manifestations of HPV infection. HPV DNA can be found in all grades of cervical intraepithelial neoplasia (CIN I-III), and a specific subset of HPV types can be found in carcinoma in situ of the cervix. Consequently, women with genital warts, containing specific HPV types, are considered to be at high risk for the development of cervical cancer.

The most common disease associated with papillomavirus infection is benign skin warts, or common warts. Common warts generally contain HPV types 1, 2, 3, 4 or 10. Other conditions caused by papillomavirus include, e.g., laryngeal papillomas, which are benign epithelial tumors of the larynx. Two papillomavirus types, HPV-6 and HPV-11, are most commonly associated with laryngeal papillomas. The compositions described herein can be used to treat these diseases and conditions.

The compositions described herein can also be used in the treatment of epidermodysplasia verruciformis (EV), a rare genetically transmitted disease characterized by disseminated flat warts that appear as small reddish macules.

In addition, the compositions described herein can be used to treat lesions resulting from cellular transformation for which HPV is an etiological agent, e.g., in the treatment of cervical cancer.

The compositions described herein can also be used in the treatment of HPV-induced dysplasias, e.g., penile, vulvar, cervical, vaginal oral, anal, and pharyngeal dysplasias, and in the treatment of HPV-induced cancers, e.g., penile, vulvar, cervical, vaginal, anal, oral, pharyngeal, and head and neck cancers.

The invention can also be practiced by including a specific dsRNA in combination with another anti-cancer chemotherapeutic agent, such as any conventional chemotherapeutic agent. The combination of a specific binding agent with such other agents can potentiate the chemotherapeutic protocol. Numerous chemotherapeutic protocols will present themselves in the mind of the skilled practitioner as being capable of incorporation into the method of the invention. Any chemotherapeutic agent can be used, including alkylating agents, antimetabolites, hormones and antagonists, radioisotopes, as well as natural products. For example, the compound of the invention can be administered with antibiotics such as doxorubicin and other anthracycline analogs, nitrogen mustards such as cyclophosphamide, pyrimidine analogs such as 5-fluorouracil, cisplatin, hydroxyurea, taxol and its natural and synthetic derivatives, and the like. As another example, in the case of mixed tumors, such as adenocarcinoma of the breast, where the tumors include gonadotropindependent and gonadotropin-independent cells, the compound can be administered in conjunction with leuprolide or goserelin (synthetic peptide analogs of LH-RH). Other antineoplastic protocols include the use of a tetracycline compound with another treatment modality, e.g., surgery, radiation, etc., also referred to herein as "adjunct antineoplastic modalities." Thus, the method of the invention can be employed with such conventional regimens with the benefit of reducing side effects and enhancing efficacy.

In a further alternative, the dsRNA targeting E6AP may be employed to treat neurological and behavioural disorders. E6AP has been implicated in neurological and behavioural disorders through the identification of E6AP mutations in patients having Angelman syndrome. Angelman syndrome (AS) is an imprinted neurobehavioral disorder characterized by mental retardation, absent speech, excessive laughter, seizures, ataxia, and a characteristic EEG pattern. (Hitchins, M. P. et al. 2004. Am J Med Genet A. 125(2):167-72.) It would not, presumably, be the intent of treatment to induce such conditions; rather, as observed in many hereditary defects, this evidence that E6AP has a critical role in neurological and behavioural conditions also indicates that this target may have a variety of roles in human pathologies and is likely a suitable target for other diseases in this class where silencing of E6AP will compensate for other biochemical defects or diseases. As used herein "E6AP associated disorders" include the HPV associated disorders noted above and other neurological and behavioural disorders.

Methods for Inhibiting Expression of the E6AP Gene

In yet another aspect, the invention provides a method for inhibiting the expression of the E6AP gene in a mammal. The method comprises administering a composition of Table 1 of the invention to the mammal such that expression of the target E6AP gene is silenced. Because of their high specificity, such dsRNAs of the invention specifically target RNAs (primary or processed) of the target E6AP gene. Compositions and methods for inhibiting the expression of these E6AP genes using such dsRNAs can be performed as described elsewhere herein.

In one embodiment, the method comprises administering a composition comprising a dsRNA, wherein the dsRNA comprises a nucleotide sequence which is complementary to at least a part of an RNA transcript of the E6AP gene of the mammal to be treated. When the organism to be treated is a mammal such as a human, the composition may be administered by any means known in the art including, but not limited to oral or parenteral routes, including intravenous, intramuscular, subcutaneous, transdermal, airway (aerosol), nasal, rectal, vaginal and topical (including buccal and sublingual) administration. In preferred embodiments, the compositions are administered by topical/vaginal administration or by intravenous infusion or injection.

Unless otherwise defined, all technical and scientific terms used herein have the same meaning as commonly understood by one of ordinary skill in the art to which this invention belongs. Although methods and materials similar or equivalent to those described herein can be used in the practice or testing of the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Gene Walking of the E6AP gene sIRNA design was carried out to identify siRNAs targeting human ubiquitin protein ligase E3A (ube3A, also referred to as E6AP). Human mRNA sequences to E6AP representing different isoforms (NM_130838.1, NM_130839.1, NM_000462.2) were used.

The ClustalW multiple alignment function (Thompson J. D., et al., Nucleic Acids Res. 1994, 22:4673) of the BioEdit software was used with all human E6AP isoforms to identify mRNA sequence NM_130838.1 as shortest sequence as well as to confirm sequence conservation from position 5 to 4491 (end position) of the reference sequence, a requirement for efficient targeting of all E6AP isoforms.

All possible overlapping 19mers (representing siRNA sense strand sequences) spanning E6AP reference sequence NM_130838.1 were identified, resulting in 4473 19mer candidate sequences. Combined, these candidate target sequences cover the 5'UTR, coding and 3'UTR domains of the E6AP mRNA, and the junction sites of these domains.

In order to rank and select siRNAs out of the pool of candidates, the predicted potential for interacting with irrelevant targets (off-target potential) was taken as a ranking parameter. siRNAs with low off-target potential were defined as preferable and assumed to be more specific in vivo.

For predicting siRNA-specific off-target potential, the following assumptions were made:
1) complementarity to a target gene in positions 2 to 9 (counting 5' to 3') of a strand (seed region) may be sufficient for interaction of that strand with the mRNA transcribed from the target gene and subsequent downregulation (Jackson A L, et al. Nat. Biotechnol. 2003 June; 21(6):635-7)
2) positions 1 and 19 of each strand are not relevant for off-target interactions
3) seed region may contribute more to off-target potential than rest of sequence
4) cleavage site region positions 10 and 11 (counting 5' to 3') of a strand may contribute more to off-target potential than the sequences 3' to the cleavage site (non-seed region), but not as much as the seed region
5) an off-target score can be calculated for each gene and each strand, based on complementarity of siRNA strand sequence to the gene's sequence and position of mismatches while considering assumptions 1 to 4
6) assuming potential abortion of sense strand activity by internal modifications introduced, only off-target potential of antisense strand will be relevant
7) the off-target potential of an siRNA can be inferred from the gene displaying the highest homology according to our criteria (best off-target gene), thus can be expressed by the off-target score of the respective gene To identify potential off-target genes, 19mer antisense sequences were subjected to a homology search against publicly available human mRNA sequences. To this purpose, fastA (version 3.4) searches were performed with all 19mer candidate antisense sequences against the human RefSeq database. A Perl script was used to generate antisense sequences from the candidate 19mer sequences (perl script 2). fastA search was executed with parameter/value pairs -g 30 -f 30 -L -i -H in order to take into account the homology over the full length of the 19mer and to format the output suitable for the Script analysis in the next step. The search resulted in a list of potential off-target genes for candidate siRNAs.

Further, fastA search parameters were applied with values -E 15000 in order to make database entries with more than 8 contiguous nucleobases identical to the 19mer sense strand sequences very likely to be transferred to a fastA output file while displaying the homology of the complete 19mer length (see assumption 1).

In order to identify the best off-target gene and its off-target score, the fastA output file was analyzed. The following off-target properties for each 19mer input sequence were extracted for each potential off-target gene:
Number of mismatches in seed region
Number of mismatches in non-seed region
Number of mismatches in cleavage site region The off-target score for each off-target gene was calculated as follows:
(number of seed mismatches multiplied by 10)+(number of cleavage site mismatches multiplied by 1.2)+number of non-seed mismatches The lowest off-target score was extracted for each input 19mer sequence and successively written into an output file resulting in a list of off-target scores for all siRNAs corresponding to the input 19mer sequences.

In order to generate a ranking of siRNAs, off-target scores were entered into a result table. All siRNAs were finally sorted according descending to the off-target score and sequences containing stretches with more than 3 Gs in a row were excluded from selection.

The 156 siRNAs with an off-target score of >=3 were selected and synthesized (Table 1).

TABLE 1 dsRNA targeting E6AP

| Target sequence of mRNA from human reference sequence NM_130838 (human iso3) sequence of total 19mer target site + AA at ends | Sense strand (target sequence) SEQ having double ID. overhang NO. sequence (5'-3') | | antisense strand (guide sequence) SEQ having ID. double overhang NO. sequence (5'-3') | | SEQ ID. duplex NO. name |
|---|---|---|---|---|---|
| AAAUACGAUGAAUCUACAAAAAA | 1 | AUACGAUGAAUCUACAAAUU | 157 | UUUUGUAGAUUCAUCGUAUU | 313 AL-DP-7545 |
| AAUGACUACAUUCUCAAUAAAA | 2 | UGACUACAUUCUCAAUAAAUU | 158 | UUUAUUGAGAAUGUAGUCAUU | 314 AL-DP-7558 |
| AAAGCCUGCACGAAUGAGUUUAA | 3 | AGCCUGCACGAAUGAGUUUU | 159 | AAACUCAUUCGUGCAGGCUU | 315 AL-DP-7548 |
| AAGGAUUGUCGAAAACCACUUAA | 4 | GGAUUGUCGAAAACCACUUU | 160 | AAGUGGUUUUCGACAAUCCU | 316 AL-DP-7509 |
| AACUCUCGAGAUCCUAAUUAUAA | 5 | CUCUCGAGAUCCUAAUUAUU | 161 | AUAAUUAGGAUCUCGAGAGU | 317 AL-DP-7492 |
| AAAUGUGACUUACUUAACAGAAA | 6 | AUGUGACUUACUUAACAGAUU | 162 | UCUGUUAAGUAAGUCACAUU | 318 AL-DP-7554 |
| AAGUAUACUCUCGAGAUCCUAAA | 7 | GUAUACUCUCGAGAUCCUAUU | 163 | UAGGAUCUCGAGAGUAUACUU | 319 AL-DP-7557 |
| AAAGGUUACCUACAUCUCAUAAA | 8 | AGGUUACCUACAUCUCAUAUU | 164 | UAUGAGAUGUAGGUAACCUU | 329 AL-DP-7476 |
| AAAGUACUUAUUCAGACCAGAAA | 9 | AGUACUUAUUCAGACCAGAUU | 165 | UCUGGUCUGAAUAAGUACUU | 321 AL-DP-7514 |
| AAAUCCUAAUUAUCUGAAUUUAA | 10 | AUCCUAAUUAUCUGAAUUUU | 166 | AAAUUCAGAUAAUUAGGAUU | 322 AL-DP-7540 |
| AAAAGGAUAGGUGAUAGCUCAAA | 11 | AACGAUAGGUGAUAGCUCAUU | 167 | UCAGCUAUCACCUAUCCUUU | 323 AL-DP-7397 |
| AAGGAAGCCGGAAUCUAGAUUAA | 12 | GGAAGCCGGAAUCUAGAUUU | 168 | AAUCUAGAUUCCGGCUUCCU | 324 AL-DP-7526 |
| AAUGCUUCGAAGUGCUUGAAAAA | 13 | UGCUUCGAAGUGCUUGAAAUU | 169 | UUUCAAGCACUUCGAAGCAU | 325 AL-DP-7473 |
| AAUGGAUUGUCGAAAACCACUAA | 14 | UGGAUUGUCGAAAACCACUU | 170 | AGUGGUUUUCGACAAUCCAUU | 326 AL-DP-7478 |
| AACGGCUAGAGAUGAUCGCUAAA | 15 | CGGCUAGAGAUGAUCGCUAUU | 171 | UAGCGAUCAUCUCUAGCCGUU | 327 AL-DP-7553 |
| AAACAGUCGAAAUCUAGUGAAAA | 16 | ACAGUCGAAAUCUAGUGAAUU | 172 | UUCACUAGAUUUCGACUGUU | 328 AL-DP-7395 |
| AAGAUCAGACUGUGGUCUAAAAA | 17 | GAUCAGACUGUGGUCUAAAUU | 173 | UUUAGACCACAGUCUGAUCUU | 329 AL-DP-7522 |
| AACUCGAGAUCCUAAUUAUCUAA | 18 | CUCGAGAUCCUAAUUAUCUUU | 174 | AGAUAAUUAGGAUCUCGAGUU | 330 AL-DP-7499 |
| AAUAUCGUAAUGGAGAAUAGAAA | 19 | UAUCGUAAUGGAGAAUAGAUU | 175 | UCUAUUCUCCAUUACGAUAUU | 331 AL-DP-7527 |
| AACUCAAAGUUAGACGUGACCAA | 20 | CUCAAAGUUAGACGUGACCUU | 176 | GGUCACGUCUAACUUUGAGUU | 332 AL-DP-7544 |
| AAAGGAUAGGUGAUAGCUCACAA | 21 | AGGAUAGGUGAUAGCUCACUU | 177 | GUGAGCUAUCACCUAUCGUU | 333 AL-DP-7489 |
| AACACCUAACGUGGAAUGUGAAA | 22 | CACCUAACGUGGAAUGUGAUU | 178 | UCACAUUCCACGUUAGGUGUU | 334 AL-DP-7365 |
| AAAAUCGUUCAUUCAUUUACAAA | 23 | AAUCGUUCAUUCAUUUACAUU | 179 | UGUAAAUGAAUGAACGAUUUU | 335 AL-DP-7390 |
| AACUUGACGUAUCACAAUGUAAA | 24 | CUUGACGUAUCACAAUGUAUU | 180 | UACAUUGUGAUACGUCAAGUU | 336 AL-DP-7458 |
| AAUGGUAUGUUCACAUACGAUAA | 25 | UGGUAUGUUCACAUACGAUUU | 181 | AUCGUAUGUGAACAUACCAUU | 337 AL-DP-7532 |

TABLE 1-continued dsRNA targeting E6AP

| Target sequence of mRNA from human reference sequence NM_130838 (human iso3) sequence of total 19mer target site + AA at ends | SEQ ID. NO. | Sense strand (target sequence) having double overhang sequence (5'-3') | SEQ ID. NO. | antisense strand (guide sequence) having double overhang sequence (5'-3') | SEQ ID. NO. | duplex name |
|---|---|---|---|---|---|---|
| AAGAUAGGUGAUAGCUCACAGAA | 26 | GAUAGGUGAUAGCUCACAGTT | 182 | CUGUGAGCUAUCACCUAUCTT | 338 | AL-DP-7546 |
| AACCGGCUAGAGAUGAUCGCUAA | 27 | CCGGCUAGAGAUGAUCGCUTT | 183 | AGCGAUCAUCUCUAGCCGGTT | 339 | AL-DP-7512 |
| AACAUAGUACUGGGUCUGGCUAA | 28 | CAUAGUACUGGGUCUGGCUTT | 184 | AGCCAGACCCAGUACUAUGTT | 340 | AL-DP-7470 |
| AAAAUGUAUACUCUCGAGAUCAA | 29 | AAUGUAUACUCUCGAGAUCTT | 185 | GAUCUCGAGAGUAUACAUUTT | 341 | AL-DP-7406 |
| AAAACUUUUCGUGACUUGGGAAA | 30 | AACUUUUCGUGACUUGGGATT | 186 | UCCCAAGUCACGAAAAGUUTT | 342 | AL-DP-7382 |
| AAAAAGUUAGACGUGACCAUAAA | 31 | AAAGUUAGACGUGACCAUATT | 187 | UAUGGUCACGUCUAACUUUTT | 343 | AL-DP-7547 |
| AAUGAUUACGGAGUUCUGGGAAA | 32 | UGAUUAGGGAGUUCUGGGATT | 188 | UCCCAGAACUCCCUAAUCATT | 344 | AL-DP-7490 |
| AAUACGAUCAAUCUACAAAAUAA | 33 | UACGAUGAAUCUACAAAAUTT | 189 | AUUUUGUAGAUUCAUCGUATT | 345 | AL-DP-7493 |
| AACUUGUCCGGCUAGAGAUGAAA | 34 | CUUGUCCGGCUAGAGAUGATT | 190 | UCAUCUCUAGCCGGACAAGTT | 346 | AL-DP-7529 |
| AAUAUACUCUCGAGAUCCUAAAA | 35 | UAUACUCUCGAGAUCCUAATT | 191 | UUAGGAUCUCGAGAGUAUATT | 347 | AL-DP-7400 |
| AAACUUGACGUAUCACAAUGUAA | 36 | ACUUGACGUAUCACAAUGUTT | 192 | ACAUUGUGAUACGUCAAGUTT | 348 | AL-DP-7391 |
| AAAACAGUCGAAAUCUAGUGAAA | 37 | AACAGUCGAAAUCUAGUCATT | 193 | UCACUAGAUUUCGACUGUUTT | 349 | AL-DP-7393 |
| AAUCAUUAUCGUAAUGGAGAAAA | 38 | UCAUUAUCGUAAUGGAGAATT | 194 | UUCUCCAUUACGAUAAUGATT | 350 | AL-DP-7511 |
| AAAUAGUACUGGGUCUGGCUAAA | 39 | AUAGUACUGGGUCUGGCUATT | 195 | UAGCCAGACCCAGUACUAUTT | 351 | AL-DP-7454 |
| AACCUAACGUGGAAUGUGACUAA | 40 | CCUAACGUGGAAUGUGACUTT | 196 | AGUCACAUUCCACGUUAGGTT | 352 | AL-DP-7450 |
| AAUUGUCCGGCUAGAGAUGAUAA | 41 | UUGUCCGGCUAGAGAUGAUTT | 197 | AUCAUCUCUAGCCGGACAATT | 353 | AL-DP-7533 |
| AAACCUAACGUGGAAUGUGACAA | 42 | ACCUAACGUGGAAUGUGACTT | 198 | GUCACAUUCCACGUUAGGUTT | 354 | AL-DP-7485 |
| AAUUAACAGUCGAAAUCUAGUAA | 43 | UUAACAGUCGAAAUCUAGUTT | 199 | ACUAGAUUUCGACUGUUAATT | 355 | AL-DP-7495 |
| AAUUGGCAUAGUACUGGGUCUAA | 44 | UUGGCAUAGUACUGGGUCUTT | 200 | AGACCCAGUACUAUGCCAATT | 356 | AL-DP-7456 |
| AAGAACUUUUCGUGACUUGGGAA | 45 | GAACUUUUCGUGACUUGGGTT | 201 | CCCAAGUCACGAAAAGUUCTT | 357 | AL-DP7538 |
| AAGUCCGGCUAGAGAUGAUCGAA | 46 | GUCCGGCUAGAGAUGAUCGTT | 202 | CGAUCAUCUCUAGCCGGACTT | 358 | AL-DP-7377 |
| AAGCCCUCGAGCUUUAUAAGAAA | 47 | GCCCUCGAGCUUUAUAAGATT | 203 | UCUUAUAAAGCUCGAGGGCTT | 359 | AL-DP-7405 |
| AACUCGAGCUUUAUAAGAUUAAA | 48 | CUCGAGCUUUAUAAGAUUATT | 204 | UAAUCUUAUAAAGCUCGAGTT | 360 | AL-DP-7392 |
| AAUGGCAUAGUACUGGGUCUGAA | 49 | UGGCAUAGUACUGGGUCUGTT | 205 | CAGACCCAGUACUAUGCCATT | 361 | AL-DP-7453 |
| AAACGAAUGAGUUUUGUGCUUAA | 50 | ACGAAUGAGUUUUGUGCUUTT | 206 | AAGCACAAAACUCAUUCGUTT | 362 | AL-DP-7366 |
| AAUUUCUUCGUAUGGAUAAUAAA | 51 | UUUCUUCGUAUGGAUAAUATT | 207 | UAUUAUCCAUACCAAGAAATT | 363 | AL-DP-7534 |
| AAAGACGUGACCAUAUCAUAGAA | 52 | AGACGUGACCAUAUCAUAGTT | 208 | CUAUGAUAUGGUCACGUCUTT | 364 | AL-DP-7401 |
| AAUAGUACUGGGUCUGGCUAUAA | 53 | UAGUACUGGGUCUGGCUAUTT | 209 | AUACCCAGACCCAGUACUATT | 365 | AL-DP-7523 |
| AACCUAUGGAUAAUAAUGCAGAA | 54 | CGUAUGGAUAAUAAUGCACTT | 210 | CUGCAUUAUUAUCCAUACGTT | 366 | AL-DP-7555 |
| AAUGGCUAUUUACAAUAACUGAA | 55 | UGGCUAUUUACAAUAACUGTT | 211 | CAGUUAUUGUAAAUAGCCATT | 367 | AL-DP-7536 |
| AAAAUUCGCAUGUACAGUGAAAA | 56 | AAUUCGCAUGUACAGUGAATT | 212 | UUCACUGUACAUGCGAAUUTT | 368 | AL-DP-7371 |
| AAAAUAGAAUUCGCAUGUACAAA | 57 | AAUAGAAUUCGCAUGUACATT | 213 | UGUACAUGCGAAUUCUAUUTT | 369 | AL-DP-7372 |
| AAUGGUAACCCAAUGAUGUAUAA | 58 | UGGUAACCCAAUGAUGUAUTT | 214 | AUACAUCAUUGGGUUACCATT | 370 | AL-DP-7370 |
| AAAGCCGGAAUCUAGAUUUCCAA | 59 | AGCCGGAAUCUAGAUUUCCTT | 215 | GGAAAUCUAGAUUCCGGCUTT | 371 | AL-DP-7474 |
| AAACUUUUCGUGACUUGGGAGAA | 60 | ACUUUUCGUGACUUGGGAGTT | 216 | CUCCCAAGUCACGAAAAGUTT | 372 | AL-DP-7452 |
| AAAGCCCUCGAGCUUUAUAAGAA | 61 | AGCGCUCGAGCUUUAUAAGTT | 217 | CUUAUAAAGCUCGAGGGCUTT | 373 | AL-DP-7498 |

TABLE 1-continued dsRNA targeting E6AP

| Target sequence of mRNA from human reference sequence NM_130838 (human iso3) sequence of total 19mer target site + AA at ends | SEQ ID. NO. | Sense strand (target sequence) having double overhang sequence (5'-3') | SEQ ID. NO. | antisense strand (guide sequence) having double overhang sequence (5'-3') | SEQ ID. NO. | duplex name |
|---|---|---|---|---|---|---|
| AAGAACGAAGAAUCACUGUUCAA | 62 | GAACGAAGAAUCACUGUUCTT | 218 | GAACAGUGAUUCUUCGUUCTT | 374 | AL-DP-7551 |
| AAUAUUCUGACUACAUUCUCAAA | 63 | UAUUCUGACUACAUUCUCATT | 219 | UGAGAAUGUAGUCAGAAUATT | 375 | AL-DP-7552 |
| AAGCAUCUAAUAGAACGCUACAA | 64 | GCAUCUAAUAGAACGCUACTT | 220 | GUAGCGUUCUAUUAGAUGCTT | 376 | AL-DP-7504 |
| AAUCGAAAUCUAGUGAAUGAUAA | 65 | UCGAAAUCUAGUGAAUGAUTT | 221 | AUCAUUCACUAGAUUUCGATT | 377 | AL-DP-7467 |
| AAAGUCGAAAUCUAGUGAAUGAA | 66 | AGUCGAAAUCUAGUGAAUGTT | 222 | CAUUCACUAGAUUUCGACUTT | 378 | AL-DP-7463 |
| AAGAAAGGCGCUAGAAUUCAUAA | 67 | GAAAGGCGCUAGAAUUGAUTT | 223 | AUCAAUUCUAGCGCCUUUCTT | 379 | AL-DP-7399 |
| AAAAAGGCGCUAGAAUUGAUUAA | 68 | AAAGGCGCUAGAAUUGAUUTT | 224 | AAUCAAUUCUAGCGCCUUUTT | 380 | AL-DP-7501 |
| AAAGGCGCUAGAAUUGAUUUAA | 69 | AGGCCCUAGAAUUGAUUUUTT | 225 | AAAAUCAAUUCUAGCGCCUTT | 381 | AL-DP-7385 |
| AAAGCAUCUAAUAGAACGCUAAA | 70 | AGCAUCUAAUAGAACGCUATT | 226 | UAGCGUUCUAUUAGAUGCUTT | 382 | AL-DP-7480 |
| AACAAAGCGAUGAGCAAGCUAAA | 71 | CAAAGCGAUGAGCAAGCUATT | 227 | UAGCUUGCUCAUCGCUUUGTT | 383 | AL-DP-7528 |
| AACCAUGGUUGUCUACAGGAAAA | 72 | CCAUGGUUGUCUACAGGAATT | 228 | UUCCUGUAGACAACCAUGGTT | 384 | AL-DP-7535 |
| AAAGAAAGGCGCUAGAAUUGAAA | 73 | AGAAAGGCGCUAGAAUUGATT | 229 | UCAAUUCUAGCGCCUUUCUTT | 385 | AL-DP-7403 |
| AAAACGCUACUACUACCAGUUAA | 74 | AACGCUACUACCACCAGUUTT | 230 | AACUGGUGGUAGUAGCGUUTT | 386 | AL-DP-7380 |
| AAGCGCUAGAAUUGAUUUUAAAA | 75 | GCGCUAGAAUUGAUUUUAATT | 231 | UUAAAAUCAAUUCUAGCGCTT | 387 | AL-DP-7364 |
| AAGCACGUGAUCAGUGUUGCAAA | 76 | GCACGUGAUCAGUGUUGCATT | 232 | UGCAACACUGAUCACGUGCTT | 388 | AL-DP-7469 |
| AAGAUAGUGUCCCAGUACAAAAA | 77 | GAUAGUGUCCCAGUACAAATT | 233 | UUUGUACUGGGACACUAUCTT | 389 | AL-DP-7518 |
| AAUUUGCGUGAAAGUGUUACAAA | 78 | UUUGCGUGAAAGUGUUACATT | 234 | UGUAACACUUUCACGCAAATT | 390 | AL-DP-7464 |
| AAAGUAUGUGCUACUUUUUUGAA | 79 | AGUAUGUGCUACUUUUUUGTT | 235 | CAAAAAAGUAGCACAUACUTT | 391 | AL-DP-7560 |
| AAGUAUGUCGUCUUCAUGUGUAA | 80 | GUAUGUCGUCUUCAUGUGUTT | 236 | ACACAUGAAGACGACAUACTT | 392 | AL-DP-7461 |
| AAGGUAGUCAAGCCUAUUGCAAA | 81 | GCUACUCAAGCCUAUUGCATT | 237 | UGCAAUAGGCUUGACUACCTT | 393 | AL-DP-7472 |
| AAACGUAACCUUCAAGUAUGUAA | 82 | ACGUAACCUUCAAGUAUGUTT | 238 | ACAUACUUGAAGGUUACGUTT | 394 | AL-DP-7459 |
| AAACCACGUAACCUUCAAGUAAA | 83 | ACCACGUAACCUUCAAGUATT | 239 | UACUUGAAGGUUACGUGGUTT | 395 | AL-DP-7381 |
| AACAGUAAGCUGACCUGGAAAAA | 84 | CAGUAAGCUGACCUGGAAATT | 240 | UUUCCAGGUCAGCUUACUGTT | 396 | AL-DP-7515 |
| AAAGUAGGUUUACAUUACUGAAA | 85 | AGUAGGUUUACAUUACUGATT | 241 | UCAGUAAUGUAAACCUACUTT | 397 | AL-DP-7517 |
| AAAAUGGUAGUCAAGCCUAUUAA | 86 | AAUGGUAGUCAAGCCUAUUTT | 242 | AAUAGGCUUGACUACCAUUTT | 398 | AL-DP-7521 |
| AAGCCUAUUGCAACAAAGUUAAA | 87 | GCCUAUUGCAACAAAGUUATT | 243 | UAACUUUGUUGCAAUAGGCTT | 399 | AL-DP-7530 |
| AAGACCACGUAACCUUCAAGUAA | 88 | GACCACGUAACCUUCAAGUTT | 244 | ACUUGAAGGUUACGUGGUCTT | 400 | AL-DP-7388 |
| AAUGUUAAACGUUACUUUCAUAA | 89 | UGUUAAACGUUACUUUCAUTT | 245 | AUGAAAGUAACGUUUAACATT | 401 | AL-DP-7451 |
| AAAUUGAAGCUAGCCGAAUGAAA | 90 | AUUGAAGCUAGCCGAAUGATT | 246 | UCAUUCGGCUAGCUUCAAUTT | 402 | AL-DP-7484 |
| AAAUAUAACGAGGGAUAAAUUAA | 91 | AUAUAACGAGGGAUAAAUUTT | 247 | AAUUUAUCCCUCGUUAUAUTT | 403 | AL-DP-7376 |
| AAACUUACUUAUUACCUAGAUAA | 92 | ACUUACUUAUUACCUAGAUTT | 248 | AUCUAGGUAAUAAGUAAGUTT | 404 | AL-DP-7500 |
| AAUGUUCUCGUUGUUGUUUUAAA | 93 | UGUUCUCGUUGUUGUUUUATT | 249 | UAAAACAACAACGAGAACATT | 405 | AL-DP-7488 |
| AAUUUUAAGGGUUAAAUCACUAA | 94 | UUUUAAGGGUUAAAUCACUTT | 250 | AGUGAUUUAACCCUUAAAATT | 406 | AL-DP-7541 |
| AAAGUAACAGCACAACAAAUUAA | 95 | AGUAACAGCACAACAAAUUTT | 251 | AAUUUGUUGUGCUGUUACUTT | 407 | AL-DP-7550 |
| AACAACUCCUGCUCUGAGAUAAA | 96 | CAACUCCUGCUCUGAGAUATT | 252 | UAUCUCAGAGCAGGAGUUGTT | 408 | AL-DP-7776 |

TABLE 1-continued dsRNA targeting E6AP

| Target sequence of mRNA from human reference sequence NM_130838 (human iso3) sequence of total 19mer target site + AA at ends | Sense strand (target sequence) SEQ having double ID. overhang NO. sequence (5'-3') | | antisense strand (guide sequence) SEQ having ID. double overhang NO. sequence (5'-3') | | SEQ ID. duplex NO. name |
|---|---|---|---|---|---|
| AAGAUGUGACUUACUUAACAGAA | 97 | GAUGUGACUUACUUAACAGUTT | 253 | CUGUUAAGUAAGUCACAUCTT | 409 AL-DP-7777 |
| AACAUUAUCGUAAUGGAGAAUAA | 98 | CAUUAUCGUAAUGGAGAAUUTT | 254 | AUUCUCCAUUACGAUAAUGTT | 410 AL-DP-7510 |
| AACCAUUUUAUCGAGGCACGUAA | 99 | CCAUUUUAUCGAGGCACGUTT | 255 | ACGUGCCUCGAUAAAAUGGTT | 411 AL-DP-7507 |
| AAAGUAGCCAAUCCUCUUUCUAA | 100 | AGUAGCCAAUCCUCUUUCUTT | 256 | AGAAAGAGGAUUGGCUACUTT | 412 AL-DP-7479 |
| AAUAAUAGAACGCUACUACCAAA | 101 | UAAUAGAACGCUACUACCATT | 257 | UGGUAGUAGCGUUCUAUUATT | 413 AL-DP-7542 |
| AACUUCGUGCAACUGUAGUCAAA | 102 | CUUCGUGCAACUGUAGUCATT | 258 | UGACUACAGUUGCACGAAGTT | 414 AL-DP-7494 |
| AAUCAUAUGGUGACCAAUGAAAA | 103 | UCAUAUGGUGACCAAUGAATT | 259 | UUCAUUGGUCACCAUAUGATT | 415 AL-DP-7531 |
| AAUUAAUCCGUGUUAUUGGAAAA | 104 | UUAAUCCGUGUUAUUGGAATT | 260 | UUCCAAUAACACGGAUUAATT | 416 AL-DP-7373 |
| AAAUACGCUACCUUGAUGAAAAA | 105 | AUACGCUACCUUGAUGAAATT | 261 | UUUCAUCAAGGUAGCGUAUTT | 417 AL-DP-7508 |
| AAAGCUAGCCGAAUGAAGCGAAA | 106 | AGCUAGCCGAAUGAAGCGATT | 262 | UCGCUUCAUUCGGCUAGCUTT | 418 AL-DP-7487 |
| AAUACAUACGCUACCUUGAUGAA | 107 | UACAUACGCUACCUUGAUGTT | 263 | CAUCAAGGUAGCGUAUGUATT | 419 AL-DP-7375 |
| AAAAUAUAACGAGGGAUAAAUAA | 108 | AAUAUAACGAGGGAUAAAUTT | 264 | AUUUAUCCCUCGUUAUAUUTT | 420 AL-DP-7462 |
| AAGUUCUCGUUGUUGUUUUAAAA | 109 | GUUCUCGUUGUUGUUUUAATT | 265 | UUAAAACAACAACGAGAACTT | 421 AL-DP-7513 |
| AAUGAUUGACUGAUUGUUUUAAA | 110 | UGAUUGACUGAUUGUUUUATT | 266 | UAAAACAAUCAGUCAAUCATT | 422 AL-DP-7455 |
| AAUUUAAUCCGUGUUAUUGGAAA | 111 | UUUAAUCCGUGUUAUUGGATT | 267 | UCCAAUAACACCGAUUAAATT | 423 AL-DP-7374 |
| AAUGUCCGGCUAGAGAUGAUCAA | 112 | UGUCCGGCUAGAGAUGAUCTT | 268 | GAUCAUCUCUAGCCGGACATT | 424 AL-DP-7475 |
| AAGCUAGCCGAAUGAAGCGAGAA | 113 | GCUAGCCGAAUGAAGCGAGTT | 269 | CUCGCUUCAUUCGGCUAGCTT | 425 AL-DP-7369 |
| AAGUACAUACGCUACCUUGAUAA | 114 | GUACAUACGCUACCUUGAUTT | 270 | AUCAAGGUAGCGUAUGUACTT | 426 AL-DP-7466 |
| AAUCGAGCUUUAUAAGAUUAAAA | 115 | UCGAGCUUUAUAAGAUUAATT | 271 | UUAAUCUUAUAAAGCUCGATT | 427 AL-DP-7491 |
| AACUACCACCAGUUAACUGAGAA | 116 | CUACCACCAGUUAACUGAGTT | 272 | CUCAGUUAACUGGUGGUAGTT | 426 AL-DP7482 |
| AAUUUUAUCGAGGCACGUGAUAA | 117 | UUUUAUCGAGGCACGUGAUTT | 273 | AUCACGUGCCUCGAUAAAATT | 429 AL-DP-7398 |
| AAAUUUUAUCGAGGCACGUGAAA | 118 | AUUUUAUCGAGGCACGUGATT | 274 | UCACGUGCCUCGAUAAAAUTT | 430 AL-DP-7471 |
| AAAACGUUACUUUCAUGUACUAA | 119 | AACGUUACUUUCAUGUACUTT | 275 | AGUACAUGAAAGUAACGUUTT | 431 AL-DP-7383 |
| AAAGAAUUCGCAUGUACAGUGAA | 120 | AGAAUUCGGAUGUACAGUGTT | 276 | CACUGUACAUGCGAAUUCUTT | 432 AL-DP-7367 |
| AAUCACGUAUGCCAAAGGAUUAA | 121 | UCACGUAUGCCAAAGGAUUTT | 277 | AAUCCUUUGGCAUACGUGATT | 433 AL-DP-7386 |
| AACUUUAAUCCGUGUUAUUGGAA | 122 | CUUUAAUCCGUGUUAUUGGTT | 278 | CCAAUAACACGGAUUAAAGTT | 434 AL-DP-7525 |
| AAACAUACGCUACCUUGAUGAAA | 123 | ACAUACGCUACCUUGAUGATT | 279 | UCAUCAAGGUAGCGUAUGUTT | 435 AL-DP-7486 |
| AAUCCUAGUCUUCUGUGUAUGAA | 124 | UCCUAGUCUUCUGUGUAUGTT | 280 | CAUACACAGAAGACUAGGATT | 436 AL-DP-7539 |
| AACAUUUUAUCGAGGCACGUGAA | 125 | CAUUUUAUCGAGGCACGUGTT | 281 | CACGUGCCUCGAUAAAAUGTT | 437 AL-DP-7483 |
| AAUUAACUGAUUACUGUAGAUAA | 126 | UUAACUGAUUACUGUAGAUTT | 282 | AUCUACAGUAAUCAGUUAATT | 438 AL-DP-7503 |
| AACCUUCGUGCAACUGUAGUCAA | 127 | CCUUCGUGCAACUGUAGUCTT | 283 | GACUACAGUUGCACGAAGGTT | 439 AL-DP-7537 |
| AAUGUUAGGGUACAUACGCUAAA | 128 | UGUUAGGGUACAUACGCUATT | 284 | UAGCGUAUGUACCCUAACATT | 440 AL-DP-7396 |
| AACACUGUUAGGGUACAUACGAA | 129 | CACUGUUAGGGUACAUACGTT | 265 | CGUAUGUACCCUAACACUCTT | 441 AL-DP-7404 |
| AAUGUGGCACUUUUCACCAUAAA | 130 | UGUGGCACUUUUCACCAUATT | 286 | UAUGGUGAAAAGUGCCACATT | 442 AL-DP-7543 |
| AAAUCACGUAUGCCAAAGGAUAA | 131 | AUCACGUAUGCCAAAGGAUTT | 287 | AUCCUUUGGCAUACGUGAUTT | 443 AL-DP-7379 |
| AAAGGGUACAUACGCUACCUUAA | 132 | AGGGUACAUACGCUACCUUTT | 288 | AAGGUAGCGUAUGUACCCUTT | 444 AL-DP-7502 |

TABLE 1-continued dsRNA targeting E6AP

| Target sequence of mRNA from human reference sequence NM_130838 (human iso3) sequence of total 19mer target site + AA at ends | Sense strand (target sequence) SEQ ID. NO. sequence (5'-3') having double overhang | | antisense strand (guide sequence) SEQ ID. NO. sequence (5'-3') having double overhang | | SEQ ID. duplex NO. name |
|---|---|---|---|---|---|
| AAACUAAGGUGAGACAUUGAUAA | 133 | ACUAAGGUGAGACAUUGAUTT | 289 | AUCAAUGUCUCACCUUAGUTT | 445 AL-DP-7519 |
| AAUGUCACCUAACGUGGAAUGAA | 134 | UGUCACCUAACGUGGAAUGTT | 290 | CAUUCCACGUUAGGUGACATT | 446 AL-DP-7506 |
| AAAUAGAAUUCGCAUGUACAGAA | 135 | AUAGAAUUCGCAUGUACAGTT | 291 | CUGUACAUGCGAAUUCUAUTT | 447 AL-DP-7457 |
| AAUUCGUGACUUGGGAGACUCAA | 136 | UUCGUGACUUGGGAGACUCTT | 292 | GAGUCUCCCAAGUCACGAATT | 448 AL-DP-7468 |
| AAUAGAAUUCGCAUGUACAGUAA | 137 | UAGAAUUCGCAUGUACAGUTT | 293 | ACUGUACAUGCGAAUUCUATT | 449 AL-DP-7368 |
| AAUGAGGGCGUUUUAUAUAAUAA | 138 | UGAGGGCGUUUUAUAUAAUTT | 294 | AUUAUAUAAAACGCCCUCATT | 450 AL-DP-7402 |
| AAACACUGUUAGGGUACAUACAA | 139 | ACACUGUUAGGGUACAUACTT | 295 | GUAUGUACCCUAACAGUGUTT | 451 AL-DP-7481 |
| AAUUCUCGUUGUUGUUUUAAGAA | 140 | UUCUCGUUGUUGUUUUAAGTT | 296 | CUUAAAACAACAACGAGAATT | 452 AL-DP-7465 |
| AACUGUUAGGGUACAUACGCUAA | 141 | CUGUUAGGGUACAUACGCUTT | 297 | AGCGUAUGUACCCUAACAGTT | 453 AL-DP-7496 |
| AAUUUAACUAAGGUGAGACAUAA | 142 | UUUAACUAAGGUGAGACAUTT | 298 | AUGUCUCACCUUAGUUAAATT | 454 AL-DP-7549 |
| AAUAACAGUCGAAAUCUAGUGAA | 143 | UAACAGUCGAAAUCUAGUGTT | 299 | CACUAGAUUUCGACUGUUATT | 455 AL-DP-7394 |
| AAUGUGGUCUAAAUACAAUGCAA | 144 | UGUGGUCUAAAUACAAUGCTT | 300 | GCAUUGUAUUUAGACCACATT | 456 AL-DP-7477 |
| AAUCACCUAACGUGGAAUGUGAA | 145 | UCACCUAACGUGGAAUGUGTT | 301 | CACAUUCCACGUUAGGUGATT | 457 AL-DP-7516 |
| AAUUCUUAGUAUAUGAAAGGAAA | 146 | UUCUUAGUAUAUGAAAGGATT | 302 | UCCUUUCAUAUACUAAGAATT | 458 AL-DP-7556 |
| AAAAUAGAACGCUACUACCACAA | 147 | AAUAGAACGCUACUACCACTT | 303 | GUGGUAGUAGCGUUCUAUUTT | 459 AL-DP-7387 |
| AACUGAGGGCGUUUUAUAUAAAA | 148 | CUGAGGGCGUUUUAUAUAATT | 304 | UUAUAUAAAACGCCCUCAGTT | 460 AL-DP-7524 |
| AAAAAUCGUUCAUUCAUUUACAA | 149 | AAAUCGUUCAUUCAUUUACTT | 305 | GUAAAUGAAUGAACGAUUUTT | 461 AL-DP-7378 |
| AAUUUUCGUGACUUGGGAGACAA | 150 | UUUUCGUGACUUGGGAGACTT | 306 | GUCUCCCAAGUCACGAAAATT | 462 AL-DP-7389 |
| AAUCGUGCAACUGUAGUCAUCAA | 151 | UCGUGCAACUGUACUCAUCTT | 307 | GAUGACUACAGUUdCACCATT | 463 AL-DP-7384 |
| AAUCAUACAGUAAGCUGACCUAA | 152 | UCAUACAGUAAGCUGACCUTT | 308 | AGGUCAGCUUACUGUAUGATT | 464 AL-DP-7497 |
| AACGUGCAACUGUAGUCAUCUAA | 153 | CGUdCAACUGUAGUCAUCUTT | 309 | AGAUGACUACAGUUGCACGTT | 465 AL-DP-7559 |
| AAUGCCAUUAGAAGGGUCUACAA | 154 | UGCCAUUAGAACGGUCUACTT | 310 | GUAGACCCUUCUAAUGGCATT | 466 AL-DP-7520 |
| AAUUACAAUAACUGUAUACUGAA | 155 | UUACAAUAACUGUAUACUGTT | 311 | CAGUAUACAGUUAUUGUAATT | 467 AL-DP-7505 |
| AAUUCGCAUGUACAGUGAACGAA | 156 | UUCGCAUGUACAGUGAACGTT | 312 | CGUUCACUGUACAUGCGAATT | 468 AL-DP-7460 | dsRNA Synthesis

Source of Reagents

Where the source of a reagent is not specifically given herein, such reagent may be obtained from any supplier of reagents for molecular biology at a quality/purity standard for application in molecular biology.

siRNA Synthesis

Single-stranded RNAs were produced by solid phase synthesis on a scale of 1 μmole using an Expedite. 8909 synthesizer (Applied Biosystems, Applera Deutschland GmbH, Darmstadt, Germany) and controlled pore glass (CPG, 500 Å, Proligo Biochemie GmbH, Hamburg, Germany) as solid support. RNA and RNA containing 2'-O-methyl nucleotides were generated by solid phase synthesis employing the corresponding phosphoramidites and 2'-O-methyl phosphoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification of the crude oligoribonucleotides by anion exchange HPLC were carried out according to established procedures. Yields and concentrations were determined by UV absorption of a solution of the respective RNA at a wavelength of 260 nm using a spectral photometer (DU 640B, Beckman Coulter GmbH, Unterschleißheim, Germany). Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution was stored at −20° C. until use.

For the synthesis of 3'-cholesterol-conjugated siRNAs (herein referred to as -Chol-3'), an appropriately modified solid support was used for RNA synthesis. The modified solid support was prepared as follows:

Diethyl-2-azabutane-1,4-dicarboxylate AA

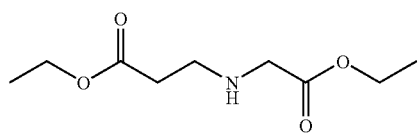

A 4.7 M aqueous solution of sodium hydroxide (50 mL) was added into a stirred, ice-cooled solution of ethyl glycinate hydrochloride (32.19 g, 0.23 mole) in water (50 mL). Then, ethyl acrylate (23.1 g, 0.23 mole) was added and the mixture was stirred at room temperature until completion of the reaction was ascertained by TLC. After 19 h the solution was partitioned with dichloromethane (3×100 mL). The organic layer was dried with anhydrous sodium sulfate, filtered and evaporated. The residue was distilled to afford AA (28.8 g, 61%).

3-{Ethoxycarbonylmethyl-[6-(9H-fluoren-9-yl-methoxycarbonyl-amino)-hexanoyl]-amino}-propionic acid ethyl ester AB

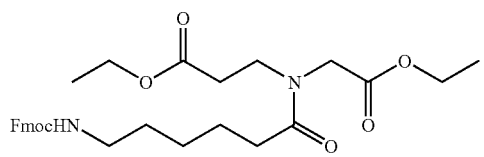

Fmoc-6-amino-hexanoic acid (9.12 g, 25.83 mmol) was dissolved in dichloromethane (50 mL) and cooled with ice. Diisopropylcarbodiimde (3.25 g, 3.99 mL, 25.83 mmol) was added to the solution at 0° C. It was then followed by the addition of Diethyl-azabutane-1,4-dicarboxylate (5 g, 24.6 mmol) and dimethylamino pyridine (0.305 g, 2.5 mmol). The solution was brought to room temperature and stirred further for 6 h. Completion of the reaction was ascertained by TLC. The reaction mixture was concentrated under vacuum and ethyl acetate was added to precipitate diisopropyl urea. The suspension was filtered. The filtrate was washed with 5% aqueous hydrochloric acid, 5% sodium bicarbonate and water. The combined organic layer was dried over sodium sulfate and concentrated to give the crude product which was purified by column chromatography (50% EtOAC/Hexanes) to yield 11.87 g (88%) of AB.

3-[(6-Amino-hexanoyl)-ethoxycarbonylmethyl-amino]-propionic acid ethyl ester AC

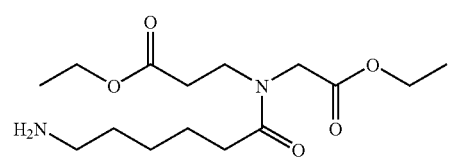

3-{(Ethoxycarbonylmethyl-[6-(9H-fluoren-9-ylmethoxy-carbonylamino)-hexanoyl]-amino}-propionic acid ethyl ester AB (11.5 g, 21.3 mmol) was dissolved in 20% piperidine in dimethylformamide at 0° C. The solution was continued stirring for 1 h. The reaction mixture was concentrated under vacuum, water was added to the residue, and the product was extracted with ethyl acetate. The crude product was purified by conversion into its hydrochloride salt.

3-({6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}ethoxycarbonylmethyl-amino)-propionic acid ethyl ester AD

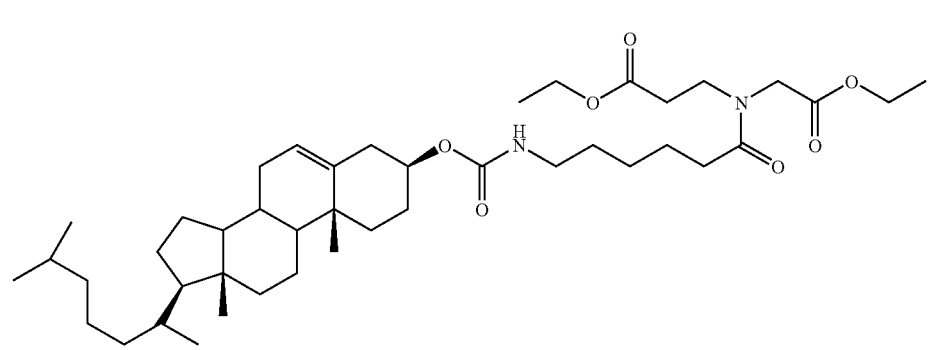

The hydrochloride salt of 3-[(6-Amino-hexanoyl)-thoxycarbonylmethyl-amino]-propionic acid ethyl ester AC (4.7 g, 14.8 mmol) was taken up in dichloromethane. The suspension was cooled to 0° C. on ice. To the suspension diisopropylethylamine (3.87 g, 5.2 mL, 30 mmol) was added. To the resulting solution cholesteryl chloroformate (6.675 g, 14.8 mmol) was added. The reaction mixture was stirred overnight. The reaction mixture was diluted with dichloromethane and washed with 10% hydrochloric acid. The product was purified by flash chromatography (10.3 g, 92%).

1-{6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}-4-oxo-pyrrolidine-3-carboxylic acid ethyl ester AE

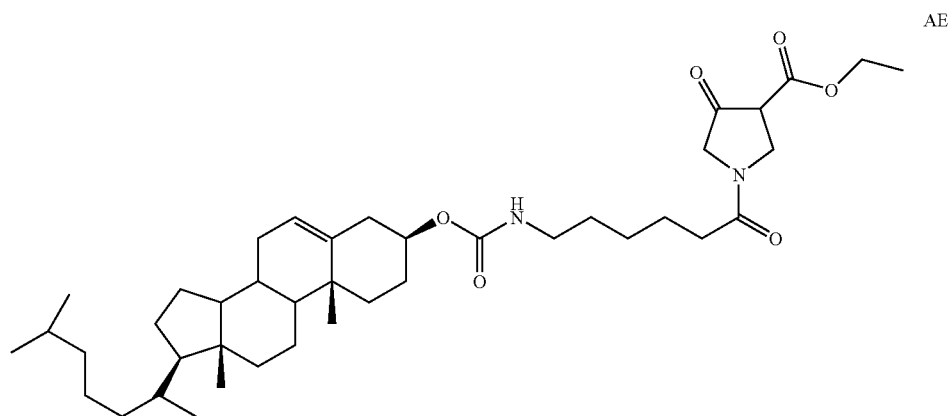

Potassium t-butoxide (1.1 g, 9.8 mmol) was slurried in 30 mL of dry toluene. The mixture was cooled to 0° C. on ice and 5 g (6.6 mmol) of diester AD was added slowly with stirring within 20 mins. The temperature was kept below 5° C. during the addition. The stirring was continued for 30 mins at 0° C. and 1 mL of glacial acetic acid was added, immediately followed by 4 g of $NaH_2PO_4 \cdot H_2O$ in 40 mL of water The resultant mixture was extracted twice with 100 mL of dichloromethane each and the combined organic extracts were washed twice with 10 mL of phosphate buffer each, dried, and evaporated to dryness. The residue was dissolved in 60 mL of toluene, cooled to 0° C. and extracted with three 50 mL portions of cold pH 9.5 carbonate buffer. The aqueous extracts were adjusted to pH 3 with phosphoric acid, and extracted with five 40 mL portions of chloroform which were combined, dried and evaporated to dryness. The residue was purified by column chromatography using 25% ethylacetate/hexane to afford 1.9 g of b-ketoester (39%).

[6-(3-Hydroxy-4-hydroxymethyl-pyrrolidin-1-yl)-6-oxo-hexyl]-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AF

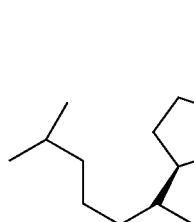
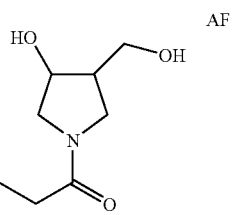

Methanol (2 mL) was added dropwise over a period of 1 h to a refluxing mixture of b-ketoester AE (1.5 g, 2.2 mmol) and sodium borohydride (0.226 g, 6 mmol) in tetrahydrofuran (10 mL). Stirring was continued at reflux temperature for 1 h. After cooling to room temperature, 1 N HCl (12.5 mL) was added, the mixture was extracted with ethylacetate (3×40 mL). The combined ethylacetate layer was dried over anhydrous sodium sulfate and concentrated under vacuum to yield the product which was purified by column chromatography (10% MeOH/CHCl$_3$) (89%).

(6-{3-[Bis-(4-methoxy-phenyl)-phenyl-methoxymethyl]-4-hydroxy-pyrrolidin-1-yl}-6-oxo-hexyl)-carbamic acid 17-1,5-dimethyl-hexyl)-10,13-dimethyl-2,3,4,7,8,9,10,11,12,13,14,15,16,17-tetradecahydro-1H-cyclopenta[a]phenanthren-3-yl ester AG Diol AF (1.25 gm 1.994 mmol) was dried by evaporating with pyridine (2×5 mL) in vacuo. Anhydrous pyridine (10 mL) and 4,4'-dimethoxytritylchloride (0.724 g, 2.13 mmol) were added with stirring. The reaction was carried out at room temperature overnight. The reaction was quenched by the addition of methanol. The reaction mixture was concentrated under vacuum and to the residue dichloromethane (50 mL) was added. The organic layer was washed with 1M aqueous sodium bicarbonate. The organic layer was dried over anhydrous sodium sulfate, filtered and concentrated. The residual pyridine was removed by evaporating with toluene. The crude product was purified by column chromatography (2% MeOH/Chloroform, Rf=0.5 in 5% MeOH/CHCl$_3$) (1.75 g, 95%).

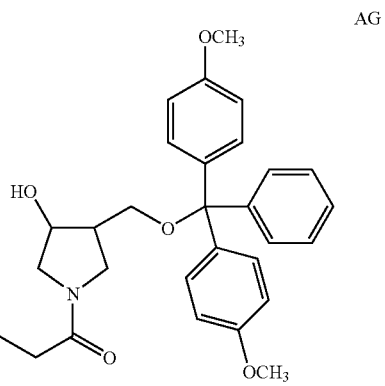

Succinic acid mono-(4-[bis-(4-methoxy-phenyl)-phenyl-methoxymethyl]-1-{6-[17(1,5-dimethyl-hexyl)-10,13-dimethyl 2,3,4,7,8,9,10,11,12,13,14,15,16,17-tetradecahydro-1H cyclopenta[a]phenanthren-3-yloxycarbonylamino]-hexanoyl}-pyrrolidin-3-yl) ester AH added. The suspension was agitated for 2 h. The CPG was filtered through a sintered funnel and washed with acetonitrile, dichloromethane and ether successively. Unreacted amino groups were masked using acetic anhydride/pyridine. The achieved loading of the CPG was measured by taking UV measurement (37 mM/g).

AH

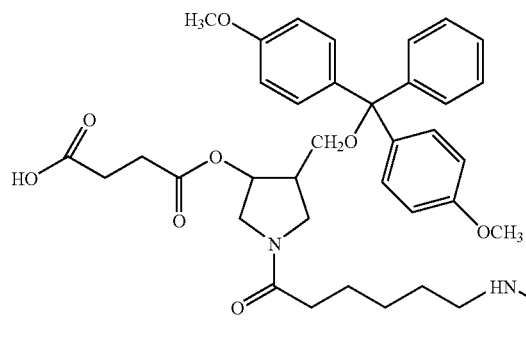
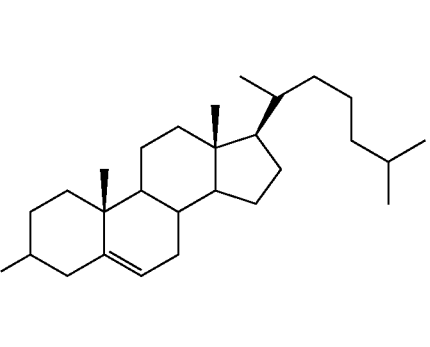

Compound AG (1.0 g, 1.05 mmol) was mixed with succinic anhydride (0.150 g, 1.5 mmol) and DMAP (0.073 g, 0.6 mmol) and dried in a vacuum at 40° C. overnight. The mixture was dissolved in anhydrous dichloroethane (3 mL), triethylamine (0.318 g, 0.440 mL, 3.15 mmol) was added and the solution was stirred at room temperature under argon atmosphere for 16 h. It was then diluted with dichloromethane (40 mL) and washed with ice cold aqueous citric acid (5 wt %, 30 mL) and water (2×20 mL). The organic phase was dried over anhydrous sodium sulfate and concentrated to dryness. The residue was used as such for the next step.

Cholesterol derivatised CPG AI

The synthesis of siRNAs bearing a 5'-12-dodecanoic acid bisdecylamide group (herein referred to as "5'-C32-") or a 5-cholesteryl derivative group (herein referred to as "5'-Chol-") was performed as described in WO 2004/065601, except that, for the cholesteryl derivative, the oxidation step was performed using the Beaucage reagent in order to introduce a phosphorothioate linkage at the 5'-end of the nucleic acid oligomer.

dsRNA Expression Vectors

In another aspect of the invention, E6AP specific dsRNA molecules that modulate E6AP gene expression activity are expressed from transcription units inserted into DNA or RNA vectors (see, e.g., Couture, A, et al., *TIG.* (1996), 12:5-10; Skillern, A., et al., International PCT Publication No. WO

AI

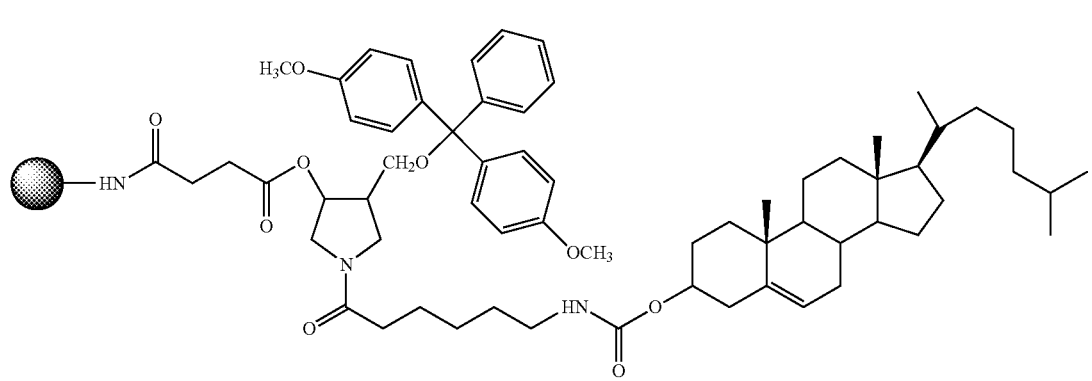

Succinate AH (0.254 g, 0.242 mmol) was dissolved in a mixture of dichloromethane/acetonitrile (3:2, 3 mL). To that solution DMAP (0.0296 g, 0.242 mmol) in acetonitrile (1.25 mL), 2,2'-Dithio-bis(5-nitropyridine) (0.075 g, 0.242 mmol) in acetonitrile/dichloroethane (3:1, 1.25 mL) were added successively. To the resulting solution triphenylphosphine (0.064 g, 0.242 mmol) in acetonitrile (0.6 ml) was added. The reaction mixture turned bright orange in color. The solution was agitated briefly using a wrist-action shaker (5 mins). Long chain alkyl amine-CPG (LCAA-CPG) (1.5 g, 61 mM) was 00/22113, Conrad, International PCT Publication No. WO 00/22114, and Conrad, U.S. Pat. No. 6,054,299). These transgenes can be introduced as a linear construct, a circular plasmid, or a viral vector, which can be incorporated and inherited as a transgene integrated into the host genome. The transgene can also be constructed to permit it to be inherited as an extrachromosomal plasmid (Gassmann, et al., *Proc. Natl. Acad. Sci. USA* (1995) 92:1292).

The individual strands of a dsRNA can be transcribed by promoters on two separate expression vectors and co-transfected into a target cell. Alternatively each individual strand of the dsRNA can be transcribed by promoters both of which are located on the same expression plasmid. In a preferred embodiment, a dsRNA is expressed as an inverted repeat joined by a linker polynucleotide sequence such that the dsRNA has a stem and loop structure.

The recombinant dsRNA expression vectors are generally DNA plasmids or viral vectors. dsRNA expressing viral vectors can be constructed based on, but not limited to, adeno-associated virus (for a review, see Muzyczka, et al., *Curr. Topics Micro. Immunol.* (1992) 158:97-129)); adenovirus (see, for example, Berkner, et al., BioTechniques (1998) 6:616), Rosenfeld et al. (1991, Science 252:431-434), and Rosenfeld et al. (1992), *Cell* 68:143-155)); or alphavirus as well as others known in the art. Retroviruses have been used to introduce a variety of genes into many different cell types, including epithelial cells, in vitro and/or in vivo (see, e.g., Eglitis, et al., Science (1985) 230:1395-1398; Danos and Mulligan, *Proc. Natl. Acad. Sci. USA* (1998) 85:6460-6464; Wilson et al., 1988, Proc. Natl. Acad. Sci. USA 85:3614-3018; Armentano et al., 1990, Proc. Natl. Acad. Sci. USA 87:61416145; Huber et al., 1991, Proc. Natl. Acad. Sci. USA 88:8039-8043; Ferry et al., 1991, Proc. Natl. Acad. Sci. USA 88:8377-8381; Chowdhury et al., 1991, Science 254:1802-1805; van Beusechem. et al., 1992, Proc. Natl. Acad. Sci. USA 89:7640-19; Kay et al., 1992, Human Gene Therapy 3:641-647; Dai et al., 1992, Proc. Natl. Acad. Sci. USA 89:10892-10895; Hwu et al., 1993, J. Immunol. 150:4104-4115; U.S. Pat. No. 4,868,116; U.S. Pat. No. 4,980,286; PCT Application WO 89/07136; PCT Application WO 89/02468; PCT Application WO 89/05345; and PCT Application WO 92/07573). Recombinant retroviral vectors capable of transducing and expressing genes inserted into the genome of a cell can be produced by transfecting the recombinant retroviral genome into suitable packaging cell lines such as PA317 and Psi-CRIP (Comette et al., 1991, Human Gene Therapy 2:5-10; Cone et al., 1984, Proc. Natl. Acad. Sci. USA 81:6349). Recombinant adenoviral vectors can be used to infect a wide variety of cells and tissues in susceptible hosts (e.g., rat, hamster, dog, and chimpanzee) (Hsu et al., 1992, J. Infectious Disease, 166:769), and also have the advantage of not requiring mitotically active cells for infection.

The promoter driving dsRNA expression in either a DNA plasmid or viral vector of the invention may be a eukaryotic RNA-polymerase I (e.g. ribosomal RNA promoter), RNA polymerase II (e.g. CMV early promoter or actin promoter or U1 snRNA promoter) or generally RNA polymerase III promoter (e.g. U6 snRNA or 7SK RNA promoter) or a prokaryotic promoter, for example the T7 promoter, provided the expression plasmid also encodes T7 RNA polymerase required for transcription from a T7 promoter. The promoter can also direct transgene expression to the pancreas (see, e.g. the insulin regulatory sequence for pancreas (Bucchini et al., 1986, Proc. Natl. Acad. Sci. USA 83:25111-2515)).

In addition, expression of the transgene can be precisely regulated, for example, by using an inducible regulatory sequence and expression systems such as a regulatory sequence that is sensitive to certain physiological regulators, e.g., circulating glucose levels, or hormones (Docherty et al., 1994, FASEB J. 8:20-24). Such inducible expression systems, suitable for the control of transgene expression in cells or in mammals include regulation by ecdysone, by estrogen, progesterone, tetracycline, chemical inducers of dimerization, and isopropyl-beta-D1-thiogalactopyranoside (EPTG). A person skilled in the art would be able to choose the appropriate regulatory/promoter sequence based on the intended use of the dsRNA transgene.

Generally, recombinant vectors capable of expressing dsRNA molecules are delivered as described below, and persist in target cells. Alternatively, viral vectors can be used that provide for transient expression of dsRNA molecules. Such vectors can be repeatedly administered as necessary. Once expressed, the dsRNAs bind to target RNA and modulate its function or expression. Delivery of dsRNA expressing vectors can be systemic, such as by intravenous or intramuscular administration, by administration to target cells ex-planted from the patient followed by reintroduction into the patient, or by any other means that allows for introduction into a desired target cell.

dsRNA expression DNA plasmids are typically transfected into target cells as a complex with cationic lipid carriers (e.g. Oligofectamine) or non-cationic lipid-based carriers (e.g. Transit-TKO™). Multiple lipid transfections for dsRNA-mediated knockdowns targeting different regions of a single E6AP gene or multiple E6AP genes over a period of a week or more are also contemplated by the invention. Successful introduction of the vectors of the invention into host cells can be monitored using various known methods. For example, transient transfection can be signaled with a reporter, such as a fluorescent marker, such as Green Fluorescent Protein (GFP). Stable transfection of ex vivo cells can be ensured using markers that provide the transfected cell with resistance to specific environmental factors (e.g., antibiotics and drugs), such as hygromycin B resistance.

The E6AP specific dsRNA molecules can also be inserted into vectors and used as gene therapy vectors for human patients. Gene therapy vectors can be delivered to a subject by, for example, intravenous injection, local administration (see U.S. Pat. No. 5,328,470) or by stereotactic injection (see e.g., Chen et al. (1994) Proc. Natl. Acad. Sci. USA 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

E6AP siRNA Screening in HCT-116 Cells

HCT-116 cells were obtained from DSMZ (Deutsche Sammlung von Mikroorganismen und Zellkulturen) (Braunschweig, Germany, cat. No. ACC 581) and cultured in McCoys (Biochrom AG, Berlin, Germany, cat. No. FI 015) supplemented to contain 10% fetal calf serum (FCS), Penicillin 100 U/ml, Streptomycin 100 µg/ml and 2 mM L-Glutamin at 37° C. in an atmosphere with 5% $CO_2$ in a humidified incubator.

For transfection with siRNA, HCT-116 cells were seeded at a density of $2.0 \times 10^4$ cells/well in 96-well plates and transfected directly. Transfection of siRNA (30 nM and 3 nM for single dose screen) was carried out with lipofectamine 2000 (Invitrogen) as described by the manufacturer.

24 hours after transfection HCT-116 cells were lysed and E6AP mRNA expression levels were quantified with the Quantigene Explore Kit (Panomics, Inc. (Fremont, Calif.) (formerly Genospectra, Inc.)) according to the standard protocol. E6AP mRNA levels were normalized to GAP-DH mRNA. For each siRNA four individual datapoints were collected. siRNA duplexes unrelated to E6AP gene were used as control. The activity of a given E6AP specific siRNA duplex was expressed as percent E6AP mRNA concentration in treated cells relative to E6AP mRNA concentration in cells treated with the control siRNA duplex.

Table 2 below provides the results. Many active siRNA molecules that target the E6AP gene were identified.

TABLE 2

Activity of dsRNA targeting E6AP

| duplex name | mean activity at 30 nM | Standard deviation at 30 nM | mean activity at 3 nM | Standard deviation at 3 nM |
|---|---|---|---|---|
| AL-DP-7545 | 9.35 | 3.36 | 14.04 | 3.82 |
| AL-DP-7558 | 12.36 | 3.07 | 18.49 | 4.36 |
| AL-DP-7548 | 12.55 | 5.85 | 18.92 | 4.72 |
| AL-DP-7509 | 14.42 | 3.99 | 19.39 | 2.71 |
| AL-DP-7492 | 11.25 | 2.53 | 19.61 | 7.89 |
| AL-DP-7554 | 14.16 | 4.56 | 19.83 | 5.15 |
| AL-DP-7557 | 16.00 | 6.50 | 19.97 | 7.04 |
| AL-DP-7476 | 14.15 | 7.05 | 20.21 | 6.19 |
| AL-DP-7514 | 24.01 | 12.46 | 20.54 | 6.13 |
| AL-DP-7540 | 15.61 | 5.14 | 21.78 | 3.95 |
| AL-DP-7397 | 13.05 | 5.68 | 22.03 | 11.42 |
| AL-DP-7526 | 15.87 | 5.65 | 22.28 | 5.61 |
| AL-DP-7473 | 17.22 | 6.09 | 22.65 | 6.64 |
| AL-DP-7478 | 16.76 | 9.85 | 22.69 | 6.84 |
| AL-DP-7553 | 23.50 | 5.15 | 23.19 | 3.34 |
| AL-DP-7395 | 17.30 | 7.48 | 23.22 | 8.88 |
| AL-DP-7522 | 26.16 | 10.71 | 23.51 | 8.18 |
| AL-DP-7499 | 14.21 | 6.15 | 23.81 | 12.13 |
| AL-DP-7527 | 24.11 | 5.05 | 23.98 | 8.89 |
| AL-DP-7544 | 17.23 | 5.90 | 24.03 | 2.56 |
| AL-DP-7489 | 23.56 | 10.21 | 24.54 | 7.57 |
| AL-DP-7365 | 14.54 | 7.13 | 24.56 | 8.90 |
| AL-DP-7390 | 16.44 | 6.37 | 24.74 | 6.73 |
| AL-DP-7458 | 14.25 | 5.11 | 25.28 | 6.56 |
| AL-DP-7532 | 21.47 | 4.18 | 25.48 | 6.40 |
| AL-DP-7546 | 17.66 | 4.28 | 25.91 | 7.73 |
| AL-DP-7512 | 27.88 | 6.58 | 26.22 | 5.07 |
| AL-DP-7470 | 28.22 | 6.50 | 26.31 | 8.12 |
| AL-DP-7406 | 20.23 | 6.01 | 26.62 | 6.35 |
| AL-DP-7382 | 17.82 | 7.24 | 26.93 | 9.30 |
| AL-DP-7547 | 24.63 | 6.66 | 28.80 | 10.23 |
| AL-DP-7490 | 25.94 | 9.32 | 28.95 | 10.29 |
| AL-DP-7493 | 12.53 | 5.36 | 29.56 | 12.54 |
| AL-DP-7529 | 17.61 | 8.36 | 29.59 | 10.53 |
| AL-DP-7400 | 21.03 | 14.86 | 30.04 | 12.58 |
| AL-DP-7391 | 26.74 | 12.00 | 30.06 | 8.07 |
| AL-DP-7393 | 22.40 | 9.77 | 30.69 | 8.51 |
| AL-DP-7511 | 26.50 | 6.02 | 30.88 | 6.43 |
| AL-DP-7454 | 25.16 | 14.85 | 31.09 | 8.75 |
| AL-DP-7450 | 20.09 | 8.43 | 32.10 | 8.57 |
| AL-DP-7533 | 26.93 | 5.86 | 33.91 | 5.52 |
| AL-DP-7485 | 27.45 | 4.36 | 34.12 | 10.28 |
| AL-DP-7495 | 28.51 | 13.42 | 34.45 | 11.20 |
| AL-DP-7456 | 16.82 | 5.62 | 34.54 | 10.30 |
| AL-DP-7538 | 29.04 | 5.12 | 34.71 | 6.42 |
| AL-DP-7377 | 22.98 | 8.19 | 35.31 | 12.53 |
| AL-DP-7405 | 21.93 | 10.30 | 35.66 | 15.22 |
| AL-DP-7392 | 23.83 | 8.93 | 36.14 | 6.31 |
| AL-DP-7453 | 25.78 | 12.10 | 36.98 | 5.22 |
| AL-DP-7366 | 19.60 | 7.30 | 37.20 | 13.88 |
| AL-DP-7534 | 26.35 | 5.24 | 37.69 | 8.49 |
| AL-DP-7401 | 28.74 | 9.10 | 37.75 | 7.70 |
| AL-DP-7523 | 33.88 | 6.85 | 39.81 | 9.45 |
| AL-DP-7555 | 29.13 | 8.87 | 40.35 | 6.23 |
| AL-DP-7536 | 32.33 | 3.49 | 41.08 | 8.00 |
| AL-DP-7371 | 25.49 | 9.83 | 42.19 | 16.08 |
| AL-DP-7372 | 21.83 | 12.03 | 42.87 | 17.78 |
| AL-DP-7370 | 24.51 | 12.64 | 43.75 | 14.09 |
| AL-DP-7474 | 32.57 | 13.13 | 44.40 | 7.78 |
| AL-DP-7452 | 30.12 | 12.02 | 46.66 | 9.19 |
| AL-DP-7498 | 32.38 | 11.81 | 54.11 | 12.74 |
| AL-DP-7504 | 15.04 | 6.39 | 19.69 | 5.67 |
| AL-DP-7467 | 19.81 | 6.42 | 21.66 | 8.12 |
| AL-DP-7463 | 26.63 | 8.84 | 21.73 | 8.80 |
| AL-DP-7399 | 15.62 | 8.32 | 22.98 | 7.65 |
| AL-DP-7501 | 17.32 | 5.24 | 23.45 | 7.44 |
| AL-DP-7385 | 17.60 | 5.11 | 28.00 | 11.84 |
| AL-DP-7480 | 21.89 | 8.21 | 29.42 | 8.64 |
| AL-DP-7528 | 26.47 | 2.94 | 30.76 | 10.87 |
| AL-DP-7535 | 26.65 | 3.13 | 31.77 | 4.34 |
| AL-DP-7403 | 24.10 | 6.21 | 38.79 | 14.41 |
| AL-DP-7380 | 29.84 | 7.65 | 40.42 | 5.72 |
| AL-DP-7469 | 17.18 | 7.41 | 21.13 | 6.29 |
| AL-DP-7518 | 15.71 | 6.00 | 21.89 | 6.68 |
| AL-DP-7464 | 29.18 | 12.30 | 22.13 | 8.99 |
| AL-DP-7560 | 17.33 | 4.85 | 24.84 | 5.80 |
| AL-DP-7461 | 30.55 | 8.26 | 25.62 | 9.48 |
| AL-DP-7472 | 25.17 | 11.50 | 26.31 | 8.61 |
| AL-DP-7459 | 29.60 | 7.71 | 27.27 | 9.68 |
| AL-DP-7381 | 17.29 | 6.63 | 27.31 | 7.42 |
| AL-DP-7515 | 32.18 | 10.22 | 29.76 | 6.01 |
| AL-DP-7517 | 29.75 | 6.99 | 29.87 | 5.69 |
| AL-DP-7521 | 28.60 | 8.06 | 31.68 | 5.72 |
| AL-DP-7530 | 31.09 | 8.09 | 31.94 | 3.36 |
| AL-DP-7388 | 22.81 | 3.80 | 32.28 | 6.23 |
| AL-DP-7451 | 22.66 | 8.92 | 32.45 | 8.26 |
| AL-DP-7484 | 26.77 | 13.00 | 32.84 | 6.95 |
| AL-DP-7376 | 34.18 | 14.11 | 39.93 | 8.41 |
| AL-DP-7500 | 32.69 | 8.47 | 41.55 | 13.32 |
| AL-DP-7776 | 17.91 | 4.95 | 21.77 | 5.04 |
| AL-DP-7777 | 21.10 | 7.60 | | |
| AL-DP-7510 | 34.70 | 5.83 | | |
| AL-DP-7507 | 35.11 | 6.78 | | |
| AL-DP-7479 | 35.29 | 13.76 | | |
| AL-DP-7542 | 36.32 | 5.00 | | |
| AL-DP-7494 | 38.34 | 12.68 | | |
| AL-DP-7531 | 38.58 | 14.26 | | |
| AL-DP-7373 | 39.04 | 16.08 | | |
| AL-DP-7508 | 39.95 | 12.87 | | |
| AL-DP-7487 | 40.48 | 15.20 | | |
| AL-DP-7375 | 41.19 | 15.06 | | |
| AL-DP-7462 | 41.61 | 17.23 | | |
| AL-DP-7513 | 41.69 | 9.15 | | |
| AL-DP-7455 | 43.35 | 12.72 | | |
| AL-DP-7374 | 43.37 | 12.26 | | |
| AL-DP-7475 | 43.68 | 11.45 | | |
| AL-DP-7369 | 43.99 | 15.44 | | |
| AL-DP-7466 | 44.27 | 15.53 | | |
| AL-DP-7491 | 45.06 | 10.32 | | |
| AL-DP-7482 | 45.06 | 12.37 | | |
| AL-DP-7398 | 45.79 | 9.50 | | |
| AL-DP-7471 | 46.11 | 13.53 | | |
| AL-DP-7383 | 46.87 | 20.08 | | |
| AL-DP-7367 | 46.96 | 16.88 | | |
| AL-DP-7386 | 47.46 | 10.01 | | |
| AL-DP-7525 | 49.60 | 14.11 | | |
| AL-DP-7486 | 49.64 | 8.95 | | |
| AL-DP-7539 | 49.97 | 12.73 | | |
| AL-DP-7483 | 49.97 | 12.50 | | |
| AL-DP-7503 | 51.28 | 7.08 | | |
| AL-DP-7537 | 53.19 | 7.75 | | |
| AL-DP-7396 | 54.11 | 13.02 | | |
| AL-DP-7404 | 54.96 | 17.72 | | |
| AL-DP-7543 | 55.48 | 9.23 | | |
| AL-DP-7379 | 55.82 | 18.47 | | |
| AL-DP-7502 | 56.15 | 16.52 | | |
| AL-DP-7519 | 56.15 | 13.30 | | |
| AL-DP-7506 | 57.24 | 21.04 | | |
| AL-DP-7457 | 57.30 | 15.19 | | |
| AL-DP-7468 | 57.83 | 15.40 | | |
| AL-DP-7368 | 59.38 | 22.50 | | |
| AL-DP-7402 | 59.57 | 13.42 | | |
| AL-DP-7481 | 60.17 | 14.54 | | |
| AL-DP-7465 | 61.44 | 28.49 | | |
| AL-DP-7496 | 61.65 | 17.78 | | |
| AL-DP-7549 | 61.90 | 12.36 | | |
| AL-DP-7394 | 61.94 | 17.08 | | |
| AL-DP-7477 | 63.20 | 14.74 | | |
| AL-DP-7516 | 67.72 | 19.24 | | |
| AL-DP-7556 | 69.49 | 13.89 | | |
| AL-DP-7387 | 72.14 | 16.20 | | |
| AL-DP-7524 | 72.52 | 19.76 | | |
| AL-DP-7378 | 73.44 | 19.20 | | |
| AL-DP-7389 | 73.74 | 23.83 | | |
| AL-DP-7384 | 76.45 | 21.99 | | |
| AL-DP-7497 | 77.66 | 22.60 | | |

TABLE 2-continued

Activity of dsRNA targeting E6AP

| duplex name | mean activity at 30 nM | Standard deviation at 30 nM | mean activity at 3 nM | Standard deviation at 3 nM |
|---|---|---|---|---|
| AL-DP-7559 | 78.86 | 16.61 | | |
| AL-DP-7520 | 85.45 | 14.83 | | |
| AL-DP-7505 | 86.86 | 39.07 | | |
| AL-DP-7460 | 100.95 | 22.69 | | |

Testing of Chemically Modified dsRNA Targeting E6AP

Chemically modified dsRNA were tested to identify their relative abilities to reduce the expression level of mRNA encoding E6AP in a cell. The assay conditions described above for HCT-116 cells were employed. The activity of a given E6AP specific siRNA duplex was expressed as percent E6AP mRNA concentration in treated cells relative to E6AP mRNA concentration in cells treated with the control siRNA duplex.

1. Chemically Modified dsRNA

Table 3 sets forth dsRNA compositions of the invention. In this table the unmodified sequence is followed by the same sequence containing one or more nucleotide modifications.

TABLE 3

| sense strand sequence (5'-3') | SEQ ID NO: | antisense strand sequence (5'-3') | SEQ ID NO: | duplex name |
|---|---|---|---|---|
| AUACGAUGAAUCUACAAAATT | 469 | UUUUGUAGAUUCAUCGUAUTT | 644 | AL-DP-7545 |
| AUACGAUGAAUCUACAAAATsT | 470 | UUUUGUAGAUUCAUCGUAUTsT | 645 | ND-8763 |
| AuAcGAuGAAucuAcAAAATsT | 471 | UUUUGuAGAUUcAUCGuAUTsT | 646 | ND-8782 |
| AuAcGAuGAAucuAcAAAATsT | 472 | uuuuGuAGAuUcAUCGuAUTsT | 647 | ND-8801 |
| AUACGAUGAAUCUACAAAATTChol | 473 | UUUUGuAGAUUcAUCGUAUTsT | 648 | ND-8820 |
| AuAcGAuGAAucuAcAAAATTchol | 474 | UUUUGuAGAUUcAUCGUAUTsT | 649 | ND-8845 |
| AuAcGAuGAAucuAcAAAATTchol | 475 | uuuuGuAGAuUcAUCGuAUTsT | 650 | ND-8870 |
| UGACUACAUUCUCAAUAAATT | 476 | UUUAUUGAGAAUGUAGUCATT | 651 | AL-DP-7558 |
| UGACUACAUUCUCAAUAAATsT | 477 | UUUAUUGAGAAUGUAGUCATsT | 652 | ND-8764 |
| uGAcuAcAuucucAAuAAATsT | 478 | UUuAUUGAGAAUGuAGUcATsT | 653 | ND-8783 |
| uGAcuAcAuucucAAuAAATsT | 479 | uuuAuuGAGAAuGuAGUcATsT | 654 | ND-8802 |
| UGACUACAUUCUCAAUAAATTChol | 480 | UUUAUUoAGAAUGUAGUCATsT | 655 | ND-8821 |
| uGAcuAcAuucucAAuAAATTchol | 481 | UUuAUUGAGAAUGuAGUcATsT | 656 | ND-8846 |
| uGAcuAcAuucucAAuAAATTchol | 482 | uuuAuuGAGAAuGuAGUcATsT | 657 | ND-8871 |
| AGCCUGCACGAAUGAGUUUTT | 483 | AAACUCAUUCGUGCAGGCUTT | 658 | AL-DP-7548 |
| AGCCUGCACGAAUGAGUUUTsT | 484 | AAACUCAUUCGUGCAGGCUTsT | 659 | ND-8765 |
| AGccuGcAcGAAuGAGuuuTsT | 485 | AAACUcAUUCGUGcAGGCUTsT | 660 | ND-8784 |
| AGccuGcAcGAAuGAGuuuTST | 486 | AAACUcAUUCGuGcAGGCUTsT | 661 | ND-8803 |
| AGCCUGCACGAAUGAGUUUTTChol | 487 | AAACUCAUUCGUGCAGGCUTsT | 662 | ND-8822 |
| AGccuGcAcGAAuGAGuuuTTchol | 488 | AAACUcAUUCGUGcAGGCUTsT | 663 | ND-8847 |
| AGccuGcAcGAAuGAGuuuTTchol | 489 | AAACUcAUUCGuGcAGGCUTsT | 664 | ND-8872 |
| GGAUUGUCGAAAACCACUUTT | 490 | AAGUGGUUUUCGACAAUCCTT | 665 | AL-DP-7509 |
| GGAUUGUCGAAAACCACUUTsT | 491 | AAGUGGUUUUCGACAAUCCTsT | 666 | ND-8766 |
| GGAuuGuCGAAAAccAcuuTsT | 492 | AAGUGGUUUUCGAcAAUCCTST | 667 | ND-8785 |
| GGAuuGucGAAAAccAcuuTsT | 493 | AAGuGGuUuUCGAcAAUCCTsT | 668 | ND-8804 |
| GGAUUGUCGAAAACCACUUTTChol | 494 | AAGUGGUUUUCGACAAUCCTsT | 669 | ND-8823 |
| GGAuuGuCGAAAAccAcuuTTchol | 495 | AAGUGGUUUUCGAcAAUCCTsT | 670 | ND-8848 |
| GGAuuGucGAAAAccAcuuTTchol | 496 | AAGuGGuUuUCGAcAAUCCTsT | 671 | ND-8873 |
| CUCUCGAGAUCCUAAUUAUTT | 497 | AUAAUUAGGAUCUCGAGAGTT | 672 | AL-DP-7492 |
| CUCUCGAGAUCCUAAUUAUsT | 498 | AUAAUUAGGAUCUCGAGAGTsT | 673 | ND-8767 |

TABLE 3-continued

| sense strand sequence (5'-3') | SEQ ID NO: | antisense strand sequence (5'-3') | SEQ ID NO: | duplex name |
|---|---|---|---|---|
| cucucGAGAuccuAAuuAuTsT | 499 | AuAAUuAGGAUCUCGAGAGTsT | 674 | ND-8786 |
| cucucGAGAuccuAAuuAuTsT | 500 | AuAAuUAGGAUCUCGAGAGTsT | 675 | ND-8805 |
| CUCUCGAGAUCCUAAUUAUTTChol | 501 | AUAAUUAGGAUCUCGAGAGTsT | 676 | ND-8824 |
| cucucGAGAuccuAAuuAuTTchol | 502 | AuAAUuAGGAUCUCGAGAGTsT | 677 | ND-8849 |
| cucucGAGAuccuAAuuAuTTchol | 503 | AuAAuUAGGAUCUCGAGAGTsT | 678 | ND-8874 |
| AUGUGACUUACUUAACAGATT | 504 | UCUGUUAAGUAAGUCACAUTT | 679 | AL-DP-7554 |
| AUGUGACUUACUUAACAGATsT | 505 | UCUGUUAAGUAAGUCACAUTsT | 680 | ND-8768 |
| AuGuGAcuuAcuuAAcAGATsT | 506 | UCUGUuAAGuAAGUcACAUTsT | 681 | ND-8787 |
| AuGuGAcuuAcuuAAcAGATsT | 507 | UCuGuuAAGuAAGUcAcAUTsT | 682 | ND-8806 |
| AUGUGACUUACUUAACAGATTChol | 508 | UCUGUUAAGUAAGUCACAUTsT | 683 | ND-8825 |
| AuGuGAcuuAcuuAAcAGATTchol | 509 | UCUGUuAAGuAAGUcAcAUTsT | 684 | ND-8850 |
| AuGuGAcuuAcuuAAcAGATTchol | 510 | UCuGuuAAGuAAGUcAcAUTsT | 685 | ND-8875 |
| GUAUACUCUCGAGAUCCUATT | 511 | UAGGAUCUCGAGAGUAUACTT | 686 | AL-DP-7557 |
| GUAUACUCUCGAGAUCCUATsT | 512 | UAGGAUCUCGAGAGUAUACTsT | 687 | ND-8769 |
| GuAuAcucucGAGAuccuATsT | 513 | uAGGAUCUCGAGAGUAUACTsT | 688 | ND-8788 |
| GuAuAcucucGAGAuccuATsT | 514 | uAGGAUCUCGAGAGuAuACTsT | 689 | ND-8788 |
| GUAUACUCUCGAGAUCCUATTChol | 515 | UAGGAUCUCGAGAGUAUACTsT | 690 | ND-8826 |
| GuAuAcucucGAGAuccuATTchol | 516 | uAGGAUCUCGAGAGuAuACTsT | 691 | ND-8851 |
| GuAuAcucucGAGAuccuATTchol | 517 | uAGGAUCUCGAGAGuAuACTsT | 692 | ND-8851 |
| AGGUUACCUACAUCUCAUATT | 518 | UAUGAGAUGUAGGUAACCUTT | 693 | AL-DP-7476 |
| AGGUUACCUACAUCUCAUATsT | 519 | UAUGAGAUGUAGGUAACCUTsT | 694 | ND-8770 |
| AGGuuAccuAcAucucAuATsT | 520 | uAUGAGAUGuAGGuAACCUTsT | 695 | ND-8789 |
| AGGuuAccuAcAucucAuATsT | 521 | uAuGAGAuGuAGGuAACCUTST | 696 | ND-8808 |
| AGGUUACCUACAUCUCAUATTChol | 522 | UAUGAGAUGUAGGUAACCUTsT | 697 | ND-8827 |
| AGGuuAccuAcAucucAuATTchol | 523 | uAUGAGAUGuAGGuAACCUTsT | 698 | ND-8852 |
| AGGuuAccuAcAucucAuATTchol | 524 | uAuGAGAuGuAGGuAACCUTsT | 699 | ND-8877 |
| AGUACUUAUUCAGACCAGATT | 525 | UCUGGUCUGAAUAAGUACUTT | 700 | AL-DP-7514 |
| AGUACUUAUUCAGACCAGATsT | 526 | UCUGGUCUGAAUAAGUACUTsT | 701 | ND-8771 |
| AGuAcuuAuucAGAccAGATsT | 527 | UCUGGUCUGAAUAAGuACUTsT | 702 | ND-8790 |
| AGuAcuuAuucAGAccAGATsT | 528 | UCuGGUCuGAAuAAGuACUTsT | 703 | ND-8809 |
| AGUACUUAUUCAGACCAGATTChol | 529 | UCUGGUCUGAAUAAGUACUTsT | 704 | ND-8828 |
| AGuAcuuAuucAGAccAGATTchol | 530 | UCUGGUCUGAAuAAGuACUTsT | 705 | ND-8853 |
| AGuAcuuAuucAGAccAGATTchol | 531 | UCuGGUCuGAAuAAGuACUTsT | 706 | ND-8878 |
| AUCCUAAUUAUCUGAAUUUTT | 532 | AAAUUCAGAUAAUUAGGAUTT | 707 | AL-DP-7540 |
| AUCCUAAUUAUCUcAAUUUTsT | 533 | AAAUUCAGAUAAUUAGGAUTsT | 708 | ND-8772 |
| AuccuAAuuAucuGAAuuuTsT | 534 | AAAUUcAGAuAAUuAGGAUTsT | 709 | ND-8791 |
| AuccuAAuuAucuGAAuuuTsT | 535 | AAAuUcAGAuAAuUAGGAUTsT | 710 | ND-8810 |
| AUCCUAAUUAUCUGAAUUUTTChol | 536 | AAAUUCAGAUAAUUAGGAUTsT | 711 | ND-8829 |

TABLE 3-continued

| sense strand sequence (5'-3') | SEQ ID NO: | antisense strand sequence (5'-3') | SEQ ID NO: | duplex name |
|---|---|---|---|---|
| AuccuAAuuAucuGAAuuuTTchol | 537 | AAAUUcAGAuAAUuAGGAUTsT | 712 | ND-8854 |
| AuccuAAuuAucuGAAuuuTTchol | 538 | AAAuUcAGAuAAUuAGGAUTsT | 713 | ND-8879 |
| AAGGAUAGGUGAUAGCUCATT | 539 | UGAGCUAUCACCUAUCCUUTT | 714 | AL-DP-7397 |
| AAGGAUAGGUGAUAGCUCATsT | 540 | UGAGCUAUCACCUAUCCUUTsT | 715 | ND-8731 |
| AAGGAuAGGuGAuAGcucATsT | 541 | UGAGCUAUcACCuAUCCUUTsT | 716 | ND-8743 |
| AAGGAuAGGuGAUAGcucATsT | 542 | uGAGCuAUcACCUAUCCuuTsT | 717 | ND-8754 |
| AAGGAUAGGUGAUAGCUCATTChol | 543 | UGAGCUAUCACCUAUCCUUTsT | 718 | ND-8839 |
| AAGGAuAGGuGAuAGcucATTchol | 544 | UGAGCuAUcACCuAUCCUUTsT | 719 | ND-8864 |
| AAGGAuAGGuGAUAGcucATTchol | 545 | uGAGCuAUcACCuAUCCuuTsT | 720 | ND-8889 |
| GGAAGCCGGAAUCUAGAUUTT | 546 | AAUCUAGAUUCCGGCUUCCTT | 721 | AL-DP-7526 |
| GGAAGCCGGAAUCUAGAUUTsT | 547 | AAUCUAGAUUCCGGCUUCCTsT | 722 | ND-8773 |
| GGAAGccGGAAucuAGAuuTsT | 548 | AAUCuAGAUUCCGGCUUCCTsT | 723 | ND-8792 |
| GGAAGccGGAAucuAGAuuTsT | 549 | AAUCuAGAuUCCGGCuUCCTsT | 724 | ND-8811 |
| GGAAGCCGGAAUCUAGAUUTTChol | 550 | AAUCUAGAUUCCGGCUUCCTsT | 725 | ND-8830 |
| GGAAGccGGAAucuAGAuuTTChol | 551 | AAUCuAGAUUCCGGCUUCCTsT | 726 | ND-8855 |
| GGAAGccGGAAucuAGAuuTTchol | 552 | AAUCuAGAuUCCGGCuUCCTsT | 727 | ND-8880 |
| UGCUUCGAAGUGCUUGAAATT | 553 | UUUCAAGCACUUCGAAGCATT | 728 | AL-DP-7473 |
| UGCUUCGAAGUGCUUGAAATsT | 554 | UUUCAAGCACUUCGAAGCATsT | 729 | ND-8774 |
| uGcuucGAAGuGcUuGAAATsT | 555 | UUUcAAGcACUUCGAAGcATsT | 730 | ND-8793 |
| uGcuucGAAGuGcuuGAAATsT | 556 | uuUcAAGcACuUCGAAGcATsT | 731 | ND-8812 |
| UGCUUCGAAGUGCUUGAAATTChol | 557 | UUUCAAGCACUUCGAAGCATsT | 732 | ND-8831 |
| uGCuuCGAAGuGCUUGAAATTChol | 558 | UUUcAAGcACUUCGAAGcATsT | 733 | ND-8856 |
| uGcuucGAAGuGcuuGAAATTchol | 559 | uuUcAAGcACuUCGAAGcATsT | 734 | ND-8881 |
| UGGAUUGUCGAAAACCACUTT | 560 | AGUGGUUUUCGACAAUCCATT | 735 | AL-DP-7478 |
| UGGAUUGUCGAAAACCACUTsT | 561 | AGUGGUUUUCGACAAUCCATsT | 736 | ND-8775 |
| uGGAuuGucGAAAACCAcuTsT | 562 | AGUGGUUUUCGAcAAUCcATsT | 737 | ND-8794 |
| uGGAuuGucGAAAAccAcuTsT | 563 | AGuGGuuuUCGAcAAUCcATsT | 738 | ND-8813 |
| UGGAUUGUCGAAAACCACUTTChol | 564 | AGUGGUUUUCGACAAUCCATsT | 739 | ND-8832 |
| uGGAuuGucGAAAAccAcuTTchol | 565 | AGUGGUUUUCGAcAAUCcATsT | 746 | ND-8857 |
| uGGAuuGucGAAAAccAcuTTchol | 566 | AGuGGuuuUCGAcAAUCCATST | 741 | ND-8882 |
| CGGCUAGAGAUGAUCGCUATT | 567 | UAGCGAUCAUCUCUAGCCGTT | 742 | AL-DP-7553 |
| CGGCUAGAGAUGAUCGCUATsT | 568 | UAGCGAUCAUCUCUAGCCGTsT | 743 | ND-8776 |
| cGGcuAGAGAuGAucGCUATsT | 569 | uAGCGAUcAUCUCuAGCCGTsT | 744 | ND-8795 |
| cGGcuAGAGAuGAucGcuATsT | 570 | uAGCGAUcAUCUCuAGCCGTsT | 745 | ND-8795 |
| CGGCUAGAGAUGAUCGCUATTChol | 571 | UAGCGAUCAUCUCUAGCCGTsT | 746 | ND-8833 |
| cGGcuAGAGAuGAucGcuATTchol | 572 | uAGCGAUcAUCUCuAGCCGTsT | 747 | ND-8858 |
| cGGcuAGAGAuGAucGcuATTchol | 573 | uAGCGAUcAUCUCuAGCCGTsT | 748 | ND-8858 |
| ACAGUCGAAAUCUAGUGAATT | 574 | UUCACUAGAUUUCGACUGUTT | 749 | AL-DP-7395 |

TABLE 3-continued

| sense strand sequence (5'-3') | SEQ ID NO: | antisense strand sequence (5'-3') | SEQ ID NO: | duplex name |
|---|---|---|---|---|
| ACAGUCGAAAUCUAGUGAATsT | 575 | UUCACUAGAUUUCGACUGUTsT | 750 | ND-8730 |
| AcAGucGAAAucuAGuGAATsT | 576 | UUcACuAGAUUUCGACUGUTsT | 751 | ND-8742 |
| AcAGuCGAAAucuAGuGAATsT | 577 | uucACuAGAuuUCGACuGUTsT | 752 | ND-8753 |
| ACAGUCGAAAUCUAGUGAATTChol | 578 | UUCACUAGAUUUCGACUGUTsT | 753 | ND-8840 |
| AcAGucGAAAucuAGuGAATTChol | 579 | UUcACuAGAUUUCGACUGUTsT | 754 | ND-8865 |
| AcAGucGAAAucuAGuGAATTchol | 580 | uucACuAGAuuUCGACuGUTsT | 755 | ND-8890 |
| CUCGAGAUCCUAAUUAUCUTT | 581 | AGAUAAUUAGGAUCUCGAGTT | 756 | AL-DP-7499 |
| CUCGAGAUCCUAAUUAUCUTsT | 582 | AGAUAAUUAGGAUCUCGAGTsT | 757 | ND-8777 |
| cucCAGAuccuAAuuAucuTsT | 583 | AGAuAAUuAGGAUCUCGAGTsT | 758 | ND-8796 |
| cucGAGAuccuAAuuAucuTsT | 584 | AGAuAAuUAGGAUCUCGAGTsT | 759 | ND-8815 |
| CUCGAGAUCCUAAUUAUCUTTChol | 585 | AGAUAAUUAGGAUCUCGAGTsT | 760 | ND-8834 |
| cucGAGAuccuAAuuAucuTTchol | 586 | AGAuAAUuAGGAUCUCGAGTsT | 761 | ND-8859 |
| cucGAGAuccuAAuuAucuTTchol | 587 | AGAuAAuUAGGAUCUCGAGTsT | 762 | ND-8884 |
| CACCUAACGUGGAAUGUGATT | 588 | UCACAUUCCACGUUAGGUGTT | 763 | AL-DP-7365 |
| CACCUAACGUGGAAUGUGATsT | 589 | UCACAUUCCACGUUAGGUGTsT | 764 | ND-8724 |
| cAccuAAcGuGGAAuGuGATsT | 590 | UcAcAUUCcACGUuAGGUGTsT | 765 | ND-8736 |
| CAccuAAcGuGGAAUGuGATsT | 591 | UcAcAuuCcACGuUAGGuGTsT | 766 | ND-8748 |
| CACCUAACGUGGAAUGUGATTChol | 592 | UCACAUUCCACGUUAGGUGTsT | 767 | ND-8841 |
| cAccuAAcGuGGAAuGuGATTchol | 593 | UcAcAUUCcACGUuAGGUGTsT | 768 | ND-8866 |
| cAccuAACGuGGAAuGuGATTchol | 594 | UcAcAuuCcACGuuAGGuGTsT | 769 | ND-8891 |
| AAUCGUUCAUUCAUUUACATT | 595 | UGUAAAUGAAUGAACGAUUTT | 770 | AL-DP-7390 |
| AAUCGUUCAUUCAUUUACATsT | 596 | UGUAAAUGAAUGAACGAUUTsT | 771 | ND-8727 |
| AAucGuucAuucAuuuAcATsT | 597 | UGuAAAUGAAUGAACGAUUTsT | 772 | ND-8739 |
| AAucGuucAuucAuuuAcATsT | 598 | uGuAAAuGAAuGAACGAuuTsT | 773 | ND-8750 |
| AAUCGUUCAUUCAUUUACATTChol | 599 | UGUAAAUGAAUGAACGAUUTsT | 774 | ND-8842 |
| AAucGuucAuucAuuuAcATTchol | 600 | UGuAAAUGAAUGAACGAUUTsT | 775 | ND-8867 |
| AAucGuucAuucAuuuAcATTchol | 601 | uGuAAAuGAAuGAACGAuuTsT | 776 | ND-8892 |
| AACUUUUCGUGACUUGGGATT | 602 | UCCCAAGUCACGAAAAGUUTT | 777 | AL-DP-7382 |
| AACUUUUCGUGACUUGGGATsT | 603 | UCCCAAGUCACGAAAAGUUTsT | 778 | ND-8726 |
| AAcuuuucGuGAcuuGGGATsT | 604 | UCCcAAGUcACGAAAAGUUTsT | 779 | ND-8738 |
| AAcuuuucGuGAcuuGGGATsT | 605 | UCCcAAGUcACGAAAAGuuTsT | 780 | ND-8749 |
| AACUUEUUCGUGACUUGGGATTChol | 606 | UCCCAAGUCACGAAAAGUUTsT | 781 | ND-8843 |
| AAcuuuucGuGAcuuGGGATTchol | 607 | UCCcAAGUcACGAAAAGUUTsT | 782 | ND-8868 |
| AAcuuuucGuGAcuuGGGATTchol | 608 | UCCcAAGUcACGAAAAGuuTsT | 783 | ND-8893 |
| AACAGUCGAAAUCUAGUGATT | 609 | UCACUAGAUUUCGACUGUUTT | 784 | AL-DP-7393 |
| AACAGUCGAAAUCUAGUGATsT | 610 | UcACUAGAUUUCGACUGUUTT | 785 | ND-8729 |
| AAcAGucGAAAucuAGuGATsT | 611 | UcACuAGAUUUCGACUGUUTsT | 786 | ND-8741 |
| AAcAGucGAAAucuAGuGATsT | 612 | UcACuAGAuuUCGACuGuuTsT | 787 | ND-8752 |

TABLE 3-continued

| sense strand sequence (5'-3') | SEQ ID NO: | antisense strand sequence (5'-3') | SEQ ID NO: | duplex name |
|---|---|---|---|---|
| AACAGUCGAAAUCUAGUGAUUChol | 613 | UCACUAGAUUUCGACUGUUTsT | 788 | ND-8844 |
| AAcAGucGAAAucuAGuGATTchol | 614 | UcACuAGAUUUCGACUGUUTsT | 789 | ND-8869 |
| AAcAGucGAAAucuAGuGATTchol | 615 | UcACuAGAuuUCGACuGuuTsT | 790 | ND-8894 |
| ACGAAUGAGUUUUGUGCUUTT | 616 | AAGCACAAAACUCAUUCGUTT | 791 | AL-DP-7366 |
| ACGAAUGAGUUUUGUGCUUTsT | 617 | AAGCACAAAACUCAUUCGUTsT | 792 | ND-8778 |
| AcGAAuGAGuuuuGuGcuuTsT | 618 | AAGcAcAAAACUcAUUCGUTsT | 793 | ND-8797 |
| AcGAAuGAGuuuuGuGcuuTsT | 619 | AAGcAcAAAACUcAuUCGUTsT | 794 | ND-8816 |
| ACGAAUGAGUUUUGUGCUUTTChol | 620 | AAGCACAAAACUCAUUCGUTsT | 795 | ND-8835 |
| AcGAAuGAGuuuuGuGcuuTTchol | 621 | AAGcAcAAAACUcAUUCGUTsT | 796 | ND-8860 |
| AcGAAuGAGuuuuGuGcuuTTchol | 622 | AAGcAcAAAACUcAuUCGUTsT | 797 | ND-8885 |
| AAUUCGCAUGUACAGUGAAUU | 623 | UUCACUGUACAUGCGAAUUTT | 798 | AL-DP-7371 |
| AAUUCGCAUGUACAGUGAATsT | 624 | UUCACUGUACAUGCGAAUUTsT | 799 | ND-8779 |
| AAuucGcAuGuAcAGuGAATsT | 625 | UUcACUGuAcAUGCGAAUUTsT | 800 | ND-8798 |
| AAuuCGcAuGuAcAGuGAATsT | 626 | uUcACuGuAcAuGCGAAuUTsT | 801 | ND-8817 |
| AAUUCGCAUGUACAGUGAATTChol | 627 | UUCACUGUACAUGCGAAUUTsT | 802 | ND-8836 |
| AAuucGcAuGuAcAGuGAATTChol | 628 | UUcACUGuAcAUGCGAAUUTsT | 803 | ND-8861 |
| AAuucGcAUGUACAGuGAATTChol | 629 | uUCACuGuAcAUGCGAAUUTsT | 804 | ND-8886 |
| AAUAGAAUUCGCAUGUACAUU | 630 | UGUACAUGCGAAUUCUAUUTT | 805 | AL-DP-7372 |
| AAUAGAAUUCGCAUGUACATsT | 631 | UGUACAUGCGAAUUCUAUUTsT | 806 | ND87 80 |
| AAuAGAAuucGcAuGuAcATsT | 632 | UGuAcAUGCGAAUUCuAUUTsT | 807 | ND-8799 |
| AAuAGAAuuCGcAuGuAcATsT | 633 | uGuAcAUGCGAAuUCuAuUTsT | 808 | ND-8818 |
| AAUAGAAUUCGCAUGUACATTChol | 634 | UGUACAUGCGAAUUCUAUUTsT | 809 | ND-8837 |
| AAuAGAAuucGcAuGuAcATTChol | 635 | UGuAcAUGCGAAUUCuAUUTsT | 810 | ND-8862 |
| AAuAGAAuucGcAuGuACATTchol | 636 | uGuAcAuGCGAAuUCuAuUTsT | 811 | ND-8887 |
| UGGUAACCCAAUGAUGUAUUU | 637 | AUACAUCAUUGGGUUACCATT | 812 | AL-DP-7370 |
| UGGUAACCCAAUGAUGUAUTsT | 638 | AUACAUCAUUGGGUUACCATsT | 813 | ND-8781 |
| uGGuAAcccAAuGAuGuAuTsT | 639 | AuAcAUcAUUGGGUuACcATsT | 814 | ND-8800 |
| uGGuAAcccAAuGAuGuAuTsT | 640 | AuAcAUcAuUGGGuUACcATsT | 815 | ND-8819 |
| UGGUAACCCAAUGAUGUAUTTChol | 641 | AUACAUCAUUGGGUUACCATsT | 816 | ND-8838 |
| uGGuAAcccAAuGAuGuAuTTchol | 642 | AuAcAUcAUUGGGUuACcATsT | 817 | ND-8863 |
| uGGuAAcCcAAuGAuGuAUTTchol | 643 | AuAcAUcAuUGGGuUACcATsT | 818 | ND-8888 |
| cucGAGAuccuAAuuAucuTsT | 1748 | AGAuAAuuAGGAUCUCGAGTst | 1749 | ND-9300 |

Upper case letters: unmodified ribonucleotide (except for T which is an unmodified deoxyribonucleotide)
Lower case letters: ribonucloetide bearing 2'-O-methyl substituent on ribose moiety
s: Indicates position of phosphorothioate internucleoside linkage
chol: cholesterol moiety conjugated to 3' ribonucleotide.
'duplex name' means the name of the composition formed by specific hybridization of the indicated sense strand and the indicated antisense strand.

Table 4 sets forth the results of testing of dsRNA listed in Table 3.

TABLE 4

| Duplex name | Mean activity remaining after 30 nM treatment | Standard deviation | Mean activity remaining after 100 pM treatment | Standard deviation |
|---|---|---|---|---|
| AL-DP-7545 | 6.74 | 1.80 | 18.41 | 4.14 |
| ND-8763 | 6.28 | 1.79 | 21.38 | 5.93 |
| ND-8782 | 7.21 | 1.59 | 23.76 | 7.49 |
| ND-8801 | 18.52 | 2.58 | 51.10 | 12.01 |
| ND-8820 | 9.26 | 1.88 | 58.34 | 10.61 |
| ND-8845 | 34.08 | 7.03 | 69.28 | 14.97 |
| ND-8870 | 30.96 | 5.97 | 77.58 | 12.41 |
| AL-DP-7558 | 11.93 | 1.66 | 25.71 | 3.57 |
| ND-8764 | 8.97 | 1.53 | 25.81 | 7.79 |
| ND-8783 | 27.33 | 3.10 | 51.35 | 6.52 |
| ND-8802 | 28.82 | 4.39 | 91.90 | 14.32 |
| ND-8821 | 8.96 | 2.36 | 71.92 | 10.68 |
| ND-8846 | 75.94 | 17.07 | 88.87 | 7.90 |
| ND-8871 | 58.02 | 9.96 | 91.79 | 13.92 |
| AL-DP-7548 | 11.23 | 1.92 | 35.58 | 6.27 |
| ND-8765 | 8.24 | 1.01 | 45.42 | 10.63 |
| ND-8784 | 25.07 | 4.28 | 68.74 | 7.10 |
| ND-8803 | 45.89 | 10.22 | 97.46 | 12.87 |
| ND-8822 | 11.59 | 2.94 | 75.22 | 17.11 |
| ND-8847 | 64.96 | 9.30 | 100.47 | 16.50 |
| ND-8872 | 78.50 | 14.11 | 86.77 | 5.96 |
| AL-DP-7509 | 17.62 | 2.26 | 21.58 | 2.98 |
| ND-8766 | 15.26 | 1.22 | 25.45 | 2.92 |
| ND-8785 | 19.66 | 3.35 | 43.13 | 4.50 |
| ND-8804 | 21.66 | 2.34 | 50.36 | 8.66 |
| ND-8823 | 15.66 | 2.09 | 48.14 | 4.88 |
| ND-8848 | 27.84 | 3.58 | 95.42 | 20.53 |
| ND-8873 | 29.97 | 3.32 | 91.79 | 13.36 |
| AL-DP-7492 | 11.09 | 1.19 | 19.22 | 3.29 |
| ND-8767 | 11.90 | 1.73 | 20.65 | 2.66 |
| ND-8786 | 11.69 | 1.72 | 19.78 | 2.74 |
| ND-8805 | 14.97 | 1.46 | 26.41 | 6.08 |
| ND-8824 | 11.53 | 1.51 | 43.76 | 5.00 |
| ND-8849 | 25.37 | 11.97 | 43.95 | 10.44 |
| ND-8874 | 16.84 | 2.99 | 53.87 | 6.12 |
| AL-DP-7554 | 15.01 | 1.22 | 23.48 | 4.39 |
| ND-8768 | 14.46 | 1.30 | 26.79 | 4.77 |
| ND-8787 | 15.20 | 2.47 | 24.76 | 4.44 |
| ND-8806 | 15.01 | 2.02 | 33.77 | 10.43 |
| ND-8825 | 17.00 | 3.82 | 72.33 | 14.34 |
| ND-8850 | 29.25 | 7.49 | 93.94 | 19.23 |
| ND-8875 | 23.33 | 3.94 | 79.79 | 9.03 |
| AL-DP-7557 | 13.10 | 1.34 | 22.30 | 8.07 |
| ND-8769 | 11.17 | 1.10 | 24.91 | 4.44 |
| ND-8788 | 21.84 | 2.02 | 60.20 | 10.58 |
| ND-8788 | 23.53 | 1.55 | 69.43 | 13.87 |
| ND-8826 | 12.81 | 1.35 | 50.68 | 10.86 |
| ND-8851 | 36.41 | 3.49 | 116.14 | 48.06 |
| ND-8851 | 36.42 | 5.05 | 100.91 | 26.50 |
| AL-DP-7476 | 17.11 | 2.75 | 25.33 | 7.43 |
| ND-8770 | 13.36 | 1.65 | 30.58 | 8.25 |
| ND-8789 | 46.06 | 6.35 | 76.12 | 14.80 |
| ND-8808 | 43.15 | 5.55 | 98.81 | 21.90 |
| ND-8827 | 14.76 | 2.03 | 56.08 | 13.96 |
| ND-8852 | 70.35 | 13.51 | 107.70 | 22.62 |
| ND-8877 | 58.73 | 8.08 | 90.83 | 10.87 |
| AL-DP-7514 | 15.63 | 2.76 | 18.89 | 0.67 |
| ND-8771 | 14.96 | 1.69 | 23.31 | 10.62 |
| ND-8790 | 15.91 | 1.57 | 31.71 | 2.88 |
| ND-8809 | 16.79 | 2.80 | 36.42 | 5.40 |
| ND-8828 | 14.61 | 2.09 | 53.50 | 8.13 |
| ND-8853 | 34.20 | 4.88 | 81.95 | 16.33 |
| ND-8878 | 26.63 | 2.95 | 87.21 | 33.73 |
| AL-DP-7540 | 18.18 | 3.06 | 32.59 | 5.25 |
| ND-8772 | 19.31 | 2.99 | 36.01 | 5.41 |
| ND-8791 | 35.43 | 4.60 | 55.34 | 7.39 |
| ND-8810 | 17.83 | 2.64 | 25.48 | 7.36 |
| ND-8829 | 18.93 | 3.20 | 68.53 | 14.55 |
| ND-8854 | 50.71 | 6.95 | 89.19 | 9.26 |

TABLE 4-continued

| Duplex name | Mean activity remaining after 30 nM treatment | Standard deviation | Mean activity remaining after 100 pM treatment | Standard deviation |
|---|---|---|---|---|
| ND-8879 | 21.76 | 5.10 | 62.43 | 16.86 |
| AL-DP-7397 | 17.10 | 2.37 | 22.44 | 4.36 |
| ND-8731 | 17.09 | 2.86 | 31.25 | 8.34 |
| ND-8743 | 15.89 | 2.29 | 27.33 | 4.67 |
| ND-8754 | 19.53 | 2.97 | 41.57 | 9.22 |
| ND-8839 | 18.18 | 2.95 | 66.39 | 13.77 |
| ND-8864 | 19.51 | 3.79 | 59.13 | 5.60 |
| ND-8889 | 19.91 | 2.30 | 92.91 | 14.85 |
| AL-DP-7526 | 17.67 | 2.32 | 41.09 | 7.63 |
| ND-8773 | 15.59 | 1.57 | 42.07 | 6.55 |
| ND-8792 | 19.42 | 2.08 | 46.87 | 6.99 |
| ND-8811 | 34.56 | 7.82 | 72.57 | 9.85 |
| ND-8830 | 19.49 | 3.09 | 69.87 | 7.25 |
| ND-8855 | 27.49 | 4.52 | 85.38 | 13.45 |
| ND-8880 | 38.04 | 6.41 | 87.78 | 13.97 |
| AL-DP-7473 | 15.81 | 2.07 | 31.86 | 6.43 |
| ND-8774 | 15.81 | 2.61 | 30.89 | 8.60 |
| ND-8793 | 14.04 | 1.44 | 25.98 | 2.91 |
| ND-8812 | 21.16 | 3.28 | 49.59 | 8.12 |
| ND-8831 | 19.07 | 3.60 | 75.06 | 16.79 |
| ND-8856 | 17.86 | 5.51 | 65.08 | 11.14 |
| ND-8881 | 28.56 | 6.18 | 83.97 | 12.49 |
| AL-DP-7478 | 16.41 | 2.58 | 33.38 | 6.20 |
| ND-8775 | 16.74 | 1.63 | 31.52 | 2.92 |
| ND-8794 | 19.05 | 3.19 | 24.88 | 3.34 |
| ND-8813 | 17.04 | 2.34 | 26.53 | 3.90 |
| ND-8832 | 16.40 | 2.16 | 66.67 | 15.18 |
| ND-8857 | 26.53 | 6.20 | 69.13 | 9.30 |
| ND-8882 | 20.04 | 2.43 | 68.67 | 8.67 |
| AL-DP-7553 | 20.83 | 2.66 | 28.97 | 4.93 |
| ND-8776 | 21.10 | 2.76 | 29.95 | 5.15 |
| ND-8795 | 26.00 | 3.54 | 79.53 | 11.78 |
| ND-8795 | 25.14 | 3.95 | 80.83 | 12.02 |
| ND-8833 | 21.76 | 3.23 | 52.28 | 7.24 |
| ND-8858 | 33.25 | 7.09 | 92.18 | 20.40 |
| ND-8858 | 31.50 | 5.36 | 84.22 | 13.01 |
| AL-DP-7395 | 18.01 | 2.33 | 25.01 | 4.17 |
| ND-8730 | 18.63 | 2.22 | 35.55 | 6.30 |
| ND-8742 | 18.04 | 2.92 | 29.24 | 6.48 |
| ND-8753 | 19.03 | 3.21 | 50.35 | 10.66 |
| ND-8840 | 24.81 | 3.87 | 81.78 | 17.12 |
| ND-8865 | 27.65 | 3.29 | 72.55 | 12.44 |
| ND-8890 | 22.03 | 1.60 | 105.32 | 26.89 |
| AL-DP-7499 | 12.40 | 1.94 | 25.24 | 3.83 |
| ND-8777 | 12.78 | 2.14 | 25.07 | 6.35 |
| ND-8796 | 11.28 | 0.83 | 21.19 | 2.68 |
| ND-8815 | 10.85 | 1.12 | 27.56 | 7.33 |
| ND-8834 | 9.88 | 1.77 | 48.81 | 8.56 |
| ND-8859 | 38.05 | 5.09 | 56.68 | 8.15 |
| ND-8884 | 38.13 | 7.42 | 75.98 | 15.04 |
| AL-DP-7365 | 15.72 | 2.57 | 23.60 | 5.58 |
| ND-8724 | 14.88 | 2.37 | 27.95 | 11.09 |
| ND-8736 | 71.51 | 11.99 | 81.07 | 19.08 |
| ND-8748 | 71.98 | 14.80 | 82.12 | 16.76 |
| ND-8841 | 18.39 | 3.01 | 66.82 | 19.67 |
| ND-8866 | 79.40 | 15.36 | 80.86 | 15.81 |
| ND-8891 | 73.79 | 17.04 | 86.53 | 21.21 |
| AL-DP-7390 | 17.45 | 3.14 | 30.46 | 4.87 |
| ND-8727 | 17.98 | 3.47 | 44.60 | 4.60 |
| ND-8739 | 23.47 | 4.83 | 53.99 | 8.89 |
| ND-8750 | 25.98 | 3.55 | 83.20 | 10.09 |
| ND-8842 | 21.10 | 2.77 | 109.29 | 34.23 |
| ND-8867 | 44.74 | 4.83 | 91.06 | 22.68 |
| ND-8892 | 57.70 | 9.50 | 96.07 | 23.52 |
| AL-DP-7382 | 16.90 | 3.54 | 30.39 | 3.91 |
| ND-8726 | 17.17 | 3.84 | 38.93 | 6.26 |
| ND-8738 | 19.51 | 2.77 | 41.20 | 3.80 |
| ND-8749 | 17.03 | 3.66 | 34.11 | 8.30 |
| ND-8843 | 26.36 | 4.99 | 83.57 | 8.12 |
| ND-8868 | 26.78 | 3.25 | 88.44 | 7.96 |
| ND-8893 | 22.70 | 2.05 | 86.71 | 12.41 |
| AL-DP-7393 | 24.38 | 3.02 | 38.04 | 7.48 |
| ND-8729 | 29.07 | 4.34 | 59.65 | 11.35 |

TABLE 4-continued

| Duplex name | Mean activity remaining after 30 nM treatment | Standard deviation | Mean activity remaining after 100 pM treatment | Standard deviation |
|---|---|---|---|---|
| ND-8741 | 68.38 | 7.91 | 87.12 | 8.74 |
| ND-8752 | 50.68 | 7.27 | 86.26 | 11.15 |
| ND-8844 | 36.14 | 5.29 | 102.26 | 16.83 |
| ND-8869 | 71.02 | 12.42 | 97.57 | 17.41 |
| ND-8894 | 52.86 | 8.43 | 106.24 | 17.77 |
| AL-DP-7366 | 18.69 | 2.05 | 44.08 | 7.35 |
| ND-8778 | 18.46 | 2.08 | 41.29 | 5.42 |
| ND-8797 | 15.49 | 2.21 | 36.71 | 5.29 |
| ND-8816 | 13.61 | 1.76 | 33.13 | 6.21 |
| ND-8835 | 22.00 | 3.84 | 76.17 | 11.70 |
| ND-8860 | 17.81 | 4.03 | 68.48 | 8.32 |
| ND-8885 | 15.76 | 2.33 | 70.03 | 10.95 |
| AL-DP-7371 | 18.77 | 2.20 | 52.94 | 11.86 |
| ND-8779 | 19.88 | 2.86 | 56.27 | 9.68 |
| ND-8798 | 24.79 | 4.89 | 59.87 | 8.65 |
| ND-8817 | 26.06 | 2.89 | 85.76 | 15.79 |
| ND-8836 | 33.17 | 7.60 | 87.15 | 20.65 |
| ND-8861 | 78.78 | 18.21 | 88.22 | 14.97 |
| ND-8886 | 70.66 | 10.62 | 96.55 | 14.35 |
| AL-DP-7372 | 19.23 | 3.22 | 46.80 | 10.62 |
| ND-8780 | 19.94 | 0.97 | 62.29 | 12.87 |
| ND-8799 | 42.73 | 4.67 | 81.61 | 10.68 |
| ND-8818 | 88.99 | 6.53 | 104.90 | 8.74 |
| ND-8837 | 25.18 | 3.70 | 99.41 | 12.93 |
| ND-8862 | 79.80 | 15.30 | 92.36 | 10.28 |
| ND-8887 | 78.27 | 16.96 | 92.55 | 14.48 |
| AL-DP-7370 | 20.04 | 1.52 | 46.57 | 9.68 |
| ND-8781 | 16.68 | 1.83 | 62.43 | 12.82 |
| ND-8800 | 41.69 | 5.44 | 77.39 | 12.71 |
| ND-8819 | 35.98 | 3.15 | 78.56 | 17.49 |
| ND-8838 | 21.49 | 3.65 | 84.71 | 30.30 |
| ND-8863 | 59.44 | 19.74 | 91.91 | 17.80 |
| ND-8888 | 49.74 | 16.09 | 97.57 | 15.46 |

Design of siRNA Targeting HPV E1 Gene Expression

Table 5 sets forth dsRNA compositions of the invention.

TABLE 5

| Target sequence of mRNA from HPV E1 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| AAAAAUCAACGUGUUGCGAUUAA | 819 | AAAUCAACGUGUUGCGAUUTT | 945 | AAUCGCAACACGUUGAUUUTT | 1141 | ND-9061 |
| AAGAGCCUCCAAAAUUGCGUAA | 820 | GAGCCUCCAAAAUUGCGUATT | 946 | UACGCAAUUUUGGAGGCUCTT | 1142 | ND-9062 |
| AAUCAACGUGUUGCGAUUGGUAA | 821 | UCAACGUGUUGCGAUUGGUTT | 947 | ACCAAUCGCAACACGUUGATT | 1143 | ND-9063 |
| AAUCCAAAAUUGCGUAGUACAAA | 822 | UCCAAAAUUGCGUAGUACATT | 948 | UGUACUACGCAAUUUUGGATT | 1144 | ND-9064 |
| AAAAUCAACGUGUUGCGAUUGAA | 823 | AAUCAACGUGUUGCGAUUGTT | 949 | CAAUCGCAAGACGUUGAUUTT | 1145 | ND-9065 |
| AACCUCCAAAAUUGCGUAGUAAA | 824 | CCUCCAAAAUUGCGUAGUATT | 950 | UACUACGCAAUUUUGGAGGTT | 1146 | ND-9066 |
| AAAGAGCCUCCAAAAUUGCGUAA | 825 | AGAGCCUCCAAAAUUGCGUTT | 951 | ACGCAAUUUUGGAGGCUCUTT | 1147 | ND-9067 |
| AACAACGUGUUGCGAUUGGUGAA | 826 | CAACGUGUUGCGAUUGGUGTT | 952 | CACCAAUCGCAACACGUUGTT | 1148 | ND-9068 |
| AAAUAGAUGUGAUAGGGUAGAAA | 827 | AUAGAUGUGAUAGGGUAGATT | 953 | UCUACCCUAUCACAUCUAUTT | 1149 | ND-9069 |
| AAGGGAAGAGGGUACGGGAUGAA | 828 | GGGAAGAGGGUACGGGAUGTT | 954 | CAUCCCGUACCCUCUUCCCTT | 1150 | ND-9070 |
| AAAGAUUAAGUUUGCACGAGGAA | 829 | AGAUUAAGUUUGCACGAGGTT | 955 | CCUCGUGCAAACUUAAUCUTT | 1151 | ND-9071 |
| AAGGUAUCAAGGUGUAGAGUUAA | 830 | GGUAUCAAGGUGUAGAGUUTT | 956 | AACUCUACACCUUGAUACCTT | 1152 | ND-9072 |
| AAACUUAGUGAUAUUAGUGGAAA | 831 | ACUUAGUGAUAUUAGUGGATT | 957 | UCCACUAAUAUCACUAAGUTT | 1153 | ND-9073 |
| AAGAGAUUAUUUGAAAGCGAAAA | 832 | GAGAUUAUUUGAAAGCGAATT | 958 | UUCGCUUUCAAAUAAUCUCTT | 1154 | ND-9074 |
| AAAACACCAUGUAGUCAGUAUAA | 833 | AACACCAUGUAGUCAGUAUTT | 959 | AUACUGACUACAUGGUGUUTT | 1155 | ND-9075 |
| AAAGCCUCCAAAAUUGCGUAGAA | 834 | AGCCUCCAAAAUUGCGUACTT | 960 | CUACGCAAUUUUGGAGGCUTT | 1156 | ND-9076 |
| AAGCCUCCAAAAUUGCGUAGUAA | 835 | GCCUCCAAAAUUGCGUAGUTT | 961 | ACUACGCAAUUUUGGAGGCTT | 1157 | ND-9077 |
| AAGUGUAUGGAGACACGCCAGAA | 836 | GUGUAUGGAGACACGCCAGTT | 962 | CUGGCGUGUCUCCAUACACTT | 1158 | ND-9078 |
| AAGUACAAUGGGCCUACGAUAAA | 837 | GUACAAUGGGCCUACGAUATT | 963 | UAUCGUAGGCCCAUUGUACTT | 1159 | ND-9079 |
| AAUACAAUGGGCCUACGAUAAAA | 838 | UACAAUGGGCCUACGAUAATT | 964 | UUAUCGUAGGCCCAUUGUATT | 1160 | ND-9080 |
| AAUGACAUAGUAGACGAUAGUAA | 839 | UGACAUAGUAGACGAUAGUTT | 965 | ACUAUCGUCUACUAUGUCATT | 1161 | ND-9081 |
| AAGACAUAGUAGACGAUAGUGAA | 840 | GACAUAGUAGACGAUAGUGTT | 966 | CACUAUCGUCUACUAUGUCTT | 1162 | ND-9082 |

TABLE 5-continued

| Target sequence of mRNA from HPV E1 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| AAACUCUUUGCCAACGUUUAAAA | 841 | ACUCUUUGCCAACGUUUAUU | 967 | UUAAACGUUGGCAAAGAGUUU | 1163 | ND-9083 |
| AAAUAAUGACAUAGUAGACGAAA | 842 | AUAAUGACAUAGUAGACGAUU | 968 | UCGUCUACUAUGUCAUUAUU | 1164 | ND-9084 |
| AAAAGUAUUUGGGUAGUCCACAA | 843 | AAGUAUUUGGGUAGUCCACUU | 969 | GUGGACUACCCAAAUACUUU | 1165 | ND-9085 |
| AAACGUGUUGCGAUUGGUGUAAA | 844 | ACGUGUUGCGAUUGGUGUAUU | 970 | UACACCAAUCGCAACACGUU | 1166 | ND-9086 |
| AACGAAAGUAUUUGGGUAGUCAA | 845 | CGAAAGUAUUUGGGUAGUCUU | 971 | GACUACCCAAAUACUUUCGUU | 1167 | ND-9087 |
| AACUCCAAAAUUGCGUAGUACAA | 846 | CUCCAAAAUUGCGUAGUACUU | 972 | GUACUACGCAAUUUUGGAGUU | 1168 | ND-9088 |
| AAUGGUACAAUGGGCCUACGAAA | 847 | UGGUACAAUGGGCCUACGAUU | 973 | UCGUAGGCCCAUUGUACCAUU | 1169 | ND-9089 |
| AAUAAUGACAUAGUAGACGAUAA | 848 | UAAUCACAUAGUAGACGAUUU | 974 | AUCGUCUACUAUGUCAUUAUU | 1170 | ND-9090 |
| AAACAUAGUAGACGAUAGUGAAA | 849 | ACAUAGUAGACGAUAGUGAUU | 975 | UCACUAUCGUCUACUAUGUU | 1171 | ND-9091 |
| AAGUGUAGACAUUAUAAACGAAA | 850 | GUGUAGACAUUAUAAACGAUU | 976 | UCGUUUAUAAUGUCUACACUU | 1172 | ND-9092 |
| AAUAGACAUUAUAAACGAGCAAA | 851 | UAGACAUUAUAAACGAGCAUU | 977 | UGCUCGUUUAUAAUGUCUAUU | 1173 | ND-9093 |
| AAUUGCGAUUGGUGUAUUGCUAA | 852 | UUGCGAUUGGUGUAUUGCUUU | 978 | AGCAAUACACCAAUCGCAAUU | 1174 | ND-9094 |
| AAUUGGCAGACACUAAUAGUAAA | 853 | UUGGCAGACACUAAUAGUAUU | 979 | UACUAUUAGUGUCUGCCAAUU | 1175 | ND-9095 |
| AAUUCAGAAUUAGUAAGACCAAA | 854 | UUCAGAAUUAGUAAGACCAUU | 980 | UGGUCUUACUAAUUCUGAAUU | 1176 | ND-9096 |
| AAGGAGAUUAUUUGAAAGCGAAA | 855 | GGAGAUUAUUUGAAAGCGAUU | 981 | UCGCUUUCAAAUAAUCUCCUU | 1177 | ND-9097 |
| AAACCAUGUAGUCAGUAUAGUAA | 856 | ACCAUGUAGUCAGUAUAGUUU | 982 | ACUAUACUGACUACAUGGUUU | 1178 | ND-9098 |
| AAGAAGAGGGUACGGGAUGUAAA | 857 | GAAGAGGGUACGGGAUGUAUU | 983 | UACAUCCCGUACCCUCUUCUU | 1179 | ND-9099 |
| AAAUAAAUCAACGUGUUGCGAAA | 858 | AUAAAUCAACGUGUUGCGAUU | 984 | UCGCAACACGUUGAUUUAUUU | 1180 | ND-9100 |
| AACGUGUUGCGAUUGGUGUAUAA | 859 | CGUGUUGCGAUUGGUGUAUUU | 985 | AUACACCAAUCGCAACACGUU | 1181 | ND-9101 |
| AAUGGGCCUACGAUAAUGACAAA | 860 | UGGGCCUACGAUAAUGACAUU | 986 | UGUCAUUAUCGUAGGCCCAUU | 1182 | ND-9102 |
| AAUGCAUAUUACUAUAUGGUGAA | 861 | UGCAUAUUACUAUAUGGUGUU | 987 | CACCAUAUAGUAAUAUGCAUU | 1183 | ND-9103 |
| AACCAGAUUAAGUUUGCACGAAA | 862 | CCAGAUUAAGUUUGCACGAUU | 988 | UCGUGCAAACUUAAUCUGGUU | 1184 | ND-9104 |
| AAAGAUUAUUUGAAAGCGAAGAA | 863 | AGAUUAUUUGAAAGCGAAGUU | 989 | CUUCGCUUUCAAAUAAUCUUU | 1185 | ND-9105 |
| AAGUUACAGGUAGAAGGGCGCAA | 864 | GUUACAGGUAGAAGGGCGCUU | 990 | GCGCCCUUCUACCUGUAACUU | 1186 | ND-9106 |
| AAGCCAAAAUAGGUAUGUUAGAA | 865 | GCCAAAAUAGGUAUGUUAGUU | 991 | CUAACAUACCUAUUUUGGCUU | 1187 | ND-9107 |
| AAGCAUAGACCAUUGGUACAAAA | 866 | GCAUAGACCAUUGGUACAAUU | 992 | UUGUACCAAUGGUCUAUGCUU | 1188 | ND-9108 |
| AAAAAUUGCGUAGUACAGCAGAA | 867 | AAAUUGCGUAGUACAGCAGUU | 993 | GUGCUGUACUACGCAAUUUUU | 1189 | ND-9109 |
| AAAGUAUUUGGGUAGUCCACUAA | 868 | AGUAUUUGGGUAGUCCACUUU | 994 | AGUGGACUACCCAAAUACUUU | 1190 | ND-9110 |
| AAAUGACAUAGUAGACGAUAGAA | 869 | AUGACAUAGUAGACGAUAGUU | 995 | CUAUCGUCUACUAUGUCAUUU | 1191 | ND-9111 |
| AAGGUAGUCCACUUAGUGAUAAA | 870 | GGUAGUCCACUUAGUGAUAUU | 996 | UAUCACUAAGUGGACUACCUU | 1192 | ND-9112 |
| AAAGGAUAGACCAUUGGUACAAA | 871 | AGCAUAGACCAUUGGUACAUU | 997 | UGUACCAAUGGUCUAUGCUUU | 1193 | ND-9113 |
| AAUUUCAGAAUUAGUAAGACCAA | 872 | UUUCAGAAUUAGUAAGACCUU | 998 | GGUCUUACUAAUUCUGAAAUU | 1194 | ND-9114 |
| AAUGCGAUUGGUGUAUUGCUGAA | 873 | UGCGAUUGGUGUAUUGCUGUU | 999 | CAGCAAUACACCAAUCGCAUU | 1195 | ND-9115 |
| AACCAAAAUUGCGUAGUACAGAA | 874 | CCAAAAUUGCGUAGUACAGUU | 1000 | CUGUACUACGCAAUUUUGGUU | 1196 | ND-9116 |
| AAGACAGCACAUGCGUUGUUUAA | 875 | GACAGCACAUGCGUUGUUUUU | 1001 | AAACAACGCAUGUGCUGUCUU | 1197 | ND-9117 |
| AAUGUUACAGGUAGAAGGGCGAA | 876 | UGUUACAGGUAGAAGGGCGUU | 1002 | CGCCCUUCUACCUGUAACAUU | 1198 | ND-9118 |
| AAAGACAAUAAUAUUAGUCCUAA | 877 | AGACAAUAAUAUUAGUCCUUU | 1003 | AGGACUAAUAUUAUUGUCUUU | 1199 | ND-9119 |

TABLE 5-continued

| Target sequence of mRNA from HPV E1 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| AAAUGAUUAUUAACACAGGCAA | 878 | AUGAUUAUUAACACAGGCUU | 1004 | GCCUGUGUUAAAUAAUCAUTT | 1200 | ND-9120 |
| AAAGAUGUGAUAGGGUAGAUGAA | 879 | AGAUGUGAUAGGGUAGAUGTT | 1005 | CAUCUACCCUAUCACAUCUTT | 1201 | ND-9121 |
| AACUGCAAGGGUCUGUAAUAUAA | 880 | CUGCAAGGGUCUGUAAUAUTT | 1006 | AUAUUACAGACCCUUGCAGTT | 1202 | ND-9122 |
| AAUCAGAUGACGAGAACGAAAAA | 881 | UCAGAUGACGAGAACGAAATT | 1007 | UUUCGUUCUCGUCAUCUGATT | 1203 | ND-9123 |
| AACACCAUGUAGUCAGUAUAGAA | 882 | CACCAUGUAGUCAGUAUAGTT | 1008 | CUAUACUGACUACAUGGUGTT | 1204 | ND-9124 |
| AAAGACAGCACAUGCGUUGUUAA | 883 | AGACAGCACAUGCGUUGUUTT | 1009 | AACAACGCAUGUGCUGUCUTT | 1205 | ND-9125 |
| AAAGAGGGUACGGGAUGUAAUAA | 884 | AGAGGGUACGGGAUGUAAUTT | 1010 | AUUACAUCCCGUACCCUCUTT | 1206 | ND-9126 |
| AAAAAAGUAAUAAAUCAACGUAA | 885 | AAAAGUAAUAAAUCAACGUTT | 1011 | ACGUUGAUUUAUUACUUUUTT | 1207 | ND-9127 |
| AAAAAGCAUAGACCAUUGGUAAA | 886 | AAAGCAUAGACCAUUGGUATT | 1012 | UACCAAUGGUCUAUGCUUUTT | 1208 | ND-9128 |
| AAUUGUACAUUUGAAUUAUCAAA | 887 | UUGUACAUUUGAAUUAUCATT | 1013 | UGAUAAUUCAAAUGUACAATT | 1209 | ND-9129 |
| AAGUAAAGCAUAGACCAUUGGAA | 888 | GUAAAGCAUAGACCAUUGGTT | 1014 | CCAAUGGUCUAUGCUUUACTT | 1210 | ND-9130 |
| | | AAAucAAcGuGuuGcGAuuTsT | 1015 | AAUCGcAAcACGUUGAUUUTsT | 1211 | ND-9131 |
| | | GAGccuccAAAAuuGcGuAsT | 1016 | uACGcAAUUUUGGAGGCUCTsT | 1212 | ND-9132 |
| | | ucAAcGuGuuGcGAuuGGuTsT | 1017 | ACcAAUCGcAAcACGUUGATsT | 1213 | ND-9133 |
| | | uccAAAAuuGcGuAGuAcATsT | 1018 | UGuACuACGcAAUUUUGGATsT | 1214 | ND-9134 |
| | | AAucAAcGuGuuGcGAuuGTsT | 1019 | cAAUCGcAAcACGUUGAUUTsT | 1215 | ND-9135 |
| | | ccuccAAAAuuGcGuAGuATsT | 1020 | uACuACGcAAUUUUGGAGGTsT | 1216 | ND-9136 |
| | | AGAGccuccAAAAuuGcGuTsT | 1021 | ACGcAAUUUUGGAGGCUCUTsT | 1217 | ND-9137 |
| | | cAAcGuGuuGcGAuuGGuTsT | 1022 | cAGcAAUCGcAAcACGUUGTsT | 1218 | ND-9138 |
| | | AuAGAuGuGAuAGGGuAGATsT | 1023 | UCuACCCuAUcAcAUCuAUTsT | 1219 | ND-9139 |
| | | GGGAAGAGGGuAcGGGAuGTsT | 1024 | cAUCCCGuACCCUCUUCCCTsT | 1220 | ND-9140 |
| | | AGAuuAAGuuuGcAcGAGGTsT | 1025 | CCUCGUGcAAACUuAAUCUTsT | 1221 | ND-9141 |
| | | GGuAucAAGGuGuAGAGuuTsT | 1026 | AACUCuAcACCUUGAuACCTsT | 1222 | ND-9142 |
| | | AcuuAGuGAuAuuAGuGGATsT | 1027 | UCcACuAAuAUcACuAAGUTsT | 1223 | ND-9143 |
| | | GAGAuuAuuuGAAAGcGAATsT | 1028 | UUCGCUUUcAAAuAAUCUCTsT | 1224 | ND-9144 |
| | | AAcAccAuGuAGucAGuAuTsT | 1029 | AuACUGAcuACAUGGUGUUTsT | 1225 | ND-9145 |
| | | AGccuccAAAAuuGcGuAGTsT | 1030 | CuACGcAAUUUUGGAGGCUTsT | 1226 | ND-9146 |
| | | GccuccAAAAuuGcGuAGuTsT | 1031 | ACuACGcAAUUUUGGAGGCTsT | 1227 | ND-9147 |
| | | GuGuAuGGAGAcAcGccAGTsT | 1032 | CUGGCGUGUCUCcAuACACTsT | 1228 | ND-9148 |
| | | GuAcAAuGGGccuAcGAuATsT | 1033 | uAUCGuAGGCCcAUUGuACTsT | 1229 | ND-9149 |
| | | uAcAAuGGGccuAcGAuAATsT | 1034 | UuAUCGuAGGCCcAUUGuATsT | 1230 | ND-9150 |
| | | uGAcAuAGuAGAcGAuAGuTsT | 1035 | ACuAUCGUCuAcuAUGUcATsT | 1231 | ND-9151 |
| | | GAcAuAGuAGAcGAuAGuGTsT | 1036 | cACuAUCGUCuAcuAUGUCTsT | 1232 | ND-9152 |
| | | AcucuuuGccAAcGuuuAATsT | 1037 | UuAAACGUUGGcAAAGAGUTsT | 1233 | ND-9153 |
| | | AuAAuGAcAuAGuAGAcGATsT | 1038 | UCGUCuAcuAUGUcAUuAUTsT | 1234 | ND-9154 |
| | | AAGuAuuuGGGuAGuccAcTsT | 1039 | GUGGAcuACCCAAAuACUUTsT | 1235 | ND-9155 |
| | | AcGuGuuGcGAuuGGuGuATsT | 1040 | uAcACcAAUCGcAAcACGUTsT | 1236 | ND-9156 |

TABLE 5-continued

| Target sequence of mRNA from HPV E1 reference sequence (sequence of total 19mer target site + AA at both ends) | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|
| | cGAAAGuAuuuGGGuAGucTsT | 1041 | GACuACCcAAAuACUUUCGTsT | 1237 | ND-9157 |
| | cuccAAAAuuGcGuAGuAcTsT | 1042 | GuACuACGcAAUUUUGGAGTsT | 1238 | ND-9158 |
| | uGGuAcAAuGGGccuAcGATsT | 1043 | UCGuAGGCCcAUUGuACcATsT | 1239 | ND-9159 |
| | uAAuGAcAuACuAGAcGAuTsT | 1044 | AUCGUCuACuAUGUCAUuATsT | 1240 | ND-9160 |
| | AcAuAGuAGAcGAuAGuGATsT | 1045 | UcACuAUCGUCuACuAUGUTsT | 1241 | ND-9161 |
| | GuGuAGAcAuuAuAAAcGATsT | 1046 | UCGUUuAuAAUGUCuAcACTsT | 1242 | ND-9162 |
| | uAGAcAuuAuAAAcGAGcATsT | 1047 | UGCUCGUUuAuAAUGUCuATsT | 1243 | ND-9163 |
| | uuGcGAuuGGuGuAuuGcuTsT | 1048 | AGcAAuAcACcAAUCGcAATsT | 1244 | ND-9164 |
| | uuGGcAGAcAcuAAuAGuATsT | 1049 | uACuAUuAGUGUCUGCcAATsT | 1245 | ND-9165 |
| | uucAGAAuuAGuAAGAccATsT | 1050 | UGGUCUuACuAAUUCUGAATsT | 1246 | ND-9166 |
| | GGAGAuuAuuuGAAAGcGATsT | 1051 | UCGCUUUcAAAuAAUCUCCTsT | 1247 | ND-9167 |
| | AccAuGuAGucAGuAuAGuTsT | 1052 | ACuAuACUGACuAcAUGGUTsT | 1248 | ND-9168 |
| | GAAGAGGGuAcGGGAuGuATsT | 1053 | uAcAUCCCGuACCCUCUUCTsT | 1249 | ND-9169 |
| | AuAAAucAAcGuGuuGcGATsT | 1054 | UCGcAAcACGUUGAUUuAUTsT | 1250 | ND-9170 |
| | cGuGuuGcGAuuGGuGuAuTsT | 1055 | AuAcACcAAUCGcAAcACGTsT | 1251 | ND-9171 |
| | uGGGccuAcGAuAAuGAcATsT | 1056 | UGUcAUuAUCGuAGGCCcATsT | 1252 | ND-9172 |
| | uGcAuuAcuAuAuGGuGuTsT | 1057 | cACcAuAuAGuAAuAUGcATsT | 1253 | ND-9173 |
| | ccAGAuuAAGuuuGcAcGATsT | 1058 | UCGUGcAAACUuAAUCUGGTsT | 1254 | ND-9174 |
| | AGAuuAuuuGAAAGcGAAGTsT | 1059 | CUUCGCUUUcAAAuAAUCUTsT | 1255 | ND-9175 |
| | GuuAcAGGuAGAAGGGcGcTsT | 1060 | GCGCCCUUCuACCUGuAACTsT | 1256 | ND-9176 |
| | GccAAAAuAGGuAuGuuAGTsT | 1061 | CuAAcAuACCuAUUUUGGCTsT | 1257 | ND-9177 |
| | GcAuAGAccAuuGGuAcAATsT | 1062 | UUGuACcAAUGGUCuAUGCTsT | 1258 | ND-9178 |
| | AAAuuGcGuAGuAcAGcAGTsT | 1063 | CUGCUGuACuACGcAAUUUTsT | 1259 | ND-9179 |
| | AGuAuuuGGGuAGuccAcuTsT | 1064 | AGUGGACuACCcAAAuACUTsT | 1260 | ND-9180 |
| | AuGAcAuAGuAGAcGAuAGTsT | 1065 | CuAUCGUCuACuAUGUcAUTsT | 1261 | ND-9181 |
| | GGuAGuccAcuuAGuGAuATsT | 1066 | uAUcACuAAGUGGACuACCTsT | 1262 | ND-9182 |
| | AGcAuAGAccAuuGGuAcATsT | 1067 | UGuACcAAUGGUCuAUGCUTsT | 1263 | ND-9183 |
| | uuucAGAAuuAGuAAGAccTsT | 1068 | GGUCUuACuAAUUCUGAAATsT | 1264 | ND-9184 |
| | uCcGAuuGGuGuAuuGcuGTsT | 1069 | cAGcAAuAcACcAAUCGcATsT | 1265 | ND-9185 |
| | ccAAAAuuGcGuAGuAcAGTsT | 1070 | CUGuACuACGcAAUUUUGGTsT | 1266 | ND-9186 |
| | GAcAGcAcAuGcGuuGuuuTsT | 1071 | AAAcAACGcAUGUGCUGUCTsT | 1267 | ND-9187 |
| | uGuuAcAGGuAGAAGGGcGTsT | 1072 | CGCCCUUCuACCUGuAAcATsT | 1268 | ND-9188 |
| | AGAcAAuAAuAuuuAGuccuTsT | 1073 | AGGACuAAuAUuAUUGUCUTsT | 1269 | ND-9189 |
| | AuGAuuAuuuAAcAcAGGcTsT | 1074 | GCCUGUGUuAAAuAAUcAUTsT | 1270 | ND-9190 |
| | AGAuGuGAuAGGGUAGAuGTsT | 1075 | cAUCuACCCuAUcAcAUCUTsT | 1271 | ND-9191 |
| | cuGcAAGGGucuGuAAuAuTsT | 1076 | AuAUuAcAGACCCUUGcAGTsT | 1272 | ND-9192 |
| | ucAGAuGAcGAGAACGAAATsT | 1077 | UUUCGUUCUCGUcAUCUGATsT | 1273 | ND-9193 |

TABLE 5-continued

| Target sequence of mRNA from HPV E1 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
|  |  | cAccAuGuAGucAGuAuAGTsT | 1078 | CuAuACUGACuAcAUGGUGTsT | 1274 | ND-9194 |
|  |  | AGAcAGcAcAuGcGuuGuuTsT | 1079 | AAcAACGcAUGUGCUGUCUTsT | 1275 | ND-9195 |
|  |  | AGAGGGuAcGGGAuGuAAuTsT | 1080 | AUuAcAUCCCGuACCCUCUTsT | 1276 | ND-9196 |
|  |  | AAAAGuAAuAAAucAAcGuTsT | 1081 | ACGUUGAUUuAUuACUUUUTsT | 1277 | ND-9197 |
|  |  | AAAGcAuAGAccAuuGGuATsT | 1082 | uACcAAUGGUCuAUGCUUUTsT | 1278 | ND-9198 |
|  |  | uuGuAcAuuuGAAuuAucATsT | 1083 | UGAuAAUUcAAAUGuAcAATsT | 1279 | ND-9199 |
|  |  | GuAAAGcAuAGAccAuuGGTsT | 1084 | CcAAUGGUCuAUGCUUuACTsT | 1280 | ND-9200 |
| AAAUAUCAAAUAUUAGUGAAGAA | 889 | AUAUCAAAUAUUAGUGAAGTT | 1085 | CUUCACUAAUAUUUGAUAUTT | 1281 | AL-DP-8042 |
| AAUAUCAAAUAUUAGUGAAGUAA | 890 | UAUCAAAUAUUAGUGAAGUTT | 1086 | ACUUCACUAAUAUUUGAUATT | 1282 | AL-DP-8043 |
| AAGGGUAUGGCAAUACUGAAGAA | 891 | GGGUAUGGCAAUACUGAAGTT | 1087 | CUUCAGUAUUGCCAUACCCTT | 1283 | AL-DP-8044 |
| AACAACGUUUAAAUGUGUGUCAA | 892 | CAACGUUUAAAUGUGUGUCTT | 1088 | GACACACAUUUAAACGUUGTT | 1284 | AL-DP-8045 |
| AAAACGUUUAAAUGUGUGUCAAA | 893 | AACGUUUAAAUGUGUGUCATT | 1089 | UGACACACAUUUAAACGUUTT | 1285 | AL-DP-8046 |
| AAGAAAACGAUGGAGACUCUUAA | 894 | GAAAACGAUGGAGACUCUUTT | 1090 | AAGAGUCUCCAUCGUUUUCTT | 1286 | AL-DP-8047 |
| AAGCGGGUAUGGCAAUACUGAAA | 895 | GCGGGUAUGGCAAUACUGATT | 1091 | UCAGUAUUGCCAUACCCGCTT | 1287 | AL-DP-8048 |
| AACGGGUAUGGCAAUACUGAAAA | 896 | CGGGUAUGGCAAUACUGAATT | 1092 | UUCAGUAUUGCCAUACCCGTT | 1288 | AL-DP-8049 |
| AAUUAUAAACGAGCAGAAAAAAA | 897 | UUAUAAACGAGCAGAAAAATT | 1093 | UUUUCUGCUCGUUUAUAATT | 1289 | AL-DP-8050 |
| AAACAAUGUGUAGACAUUAUAAA | 898 | ACAAUGUGUAGACAUUAUATT | 1094 | UAUAAUGUCUACACAUUGUTT | 1290 | AL-DP-8051 |
| AAAUUAUAAACGAGCAGAAAAAA | 899 | AUUAUAAACGAGCAGAAAATT | 1095 | UUUUCUGCUCGUUUAUAAUTT | 1291 | AL-DP-8052 |
| AAUGUGUAGACAUUAUAAACGAA | 900 | UGUGUAGACAUUAUAAACGTT | 1096 | CGUUUAUAAUGUCUACACATT | 1292 | AL-DP-8053 |
| AAUGUGUGUCAGGACAAAAUAAA | 901 | UGUGUGUCAGGACAAAAUATT | 1097 | UAUUUUGUCCUGACACACATT | 1293 | AL-DP-8054 |
| AAACAUUAUAAACGAGCAGAAAA | 902 | ACAUUAUAAACGAGCAGAATT | 1098 | UUCUGCUCGUUUAUAAUGUTT | 1294 | AL-DP-8055 |
| AAAGACAGCGGGUAUGGCAAUAA | 903 | AGACAGCGGGUAUGGCAAUTT | 1099 | AUUGCCAUACCCGCUGUCUTT | 1295 | AL-DP-8056 |
| AAGACAGCGGGUAUGGCAAUAAA | 904 | GACAGCGGGUAUGGCAAUATT | 1100 | UAUUGCCAUACCCGCUGUCTT | 1296 | AL-DP-8057 |
| AAACAGCGGGUAUGGCAAUACAA | 905 | ACAGCGGGUAUGGCAAUACTT | 1101 | GUAUUGCCAUACCCGCUGUTT | 1297 | AL-DP-8058 |
| AAAGCGGGUAUGGCAAUACUGAA | 906 | AGCGGGUAUGGCAAUACUGTT | 1102 | CAGUAUUGCCAUACCCGCUTT | 1298 | AL-DP-8059 |
| AAAACAAUGUGUAGACAUUAUAA | 907 | AACAAUGUGUAGACAUUAUTT | 1103 | AUAAUGUCUACACAUUGUUTT | 1299 | AL-DP-8060 |
| AACAUUAUAAACGAGCAGAAAAA | 908 | CAUUAUAAACGAGCAGAAATT | 1104 | UUUCUGCUCGUUUAUAAUGTT | 1300 | AL-DP-8061 |
| AAACGUUUAAAUGUGUGUCAGAA | 909 | ACGUUUAAAUGUGUGUCAGTT | 1105 | CUGACACACAUUUAAACGUTT | 1301 | AL-DP-8062 |
| AAAAAUGUGUGUCAGGACAAAAA | 910 | AAAUGUGUGUCAGGACAAATT | 1106 | UUUGUCCUGACACACAUUUTT | 1302 | AL-DP-8063 |
| AAGGUUCUAAAACGAAAGUAUAA | 911 | GGUUCUAAAACGAAAGUAUTT | 1107 | AUACUUUCGUUUUAGAACCTT | 1303 | AL-DP-8064 |
| AAAUGUGUAGACAUUAUAAACAA | 912 | AUGUGUAGACAUUAUAAACTT | 1108 | GUUUAUAAUGUCUACACAUTT | 1304 | AL-DP-8065 |
| AAAGUAAGACCAUUUAAAAGUAA | 913 | AGUAAGACCAUUUAAAAGUTT | 1109 | ACUUUUAAAUGGUCUUACUTT | 1305 | AL-DP-8066 |
| AAUAGUAAGACCAUUUAAAAGAA | 914 | UAGUAAGACCAUUUAAAAGTT | 1110 | CUUUUAAAUGGUCUUACUATT | 1306 | AL-DP-8067 |
| AAGAAUUAGUAAGACCAUUUAAA | 915 | GAAUUAGUAACACCAUUUATT | 1111 | UAAAUGGUCUUACUAAUUCTT | 1307 | AL-DP-8068 |
| AAAUUAGUAAGACCAUUUAAAAA | 916 | AAUUAGUAAGACCAUUUAATT | 1112 | UUAAAUGGUCUUACUAAUUTT | 1308 | AL-DP-8069 |
| AAAUUAGUAAGACCAUUUAAAAA | 917 | AUUAGUAAGACCAUUUAAATT | 1113 | UUUAAAUGGUCUUACUAAUTT | 1309 | AL-DP-8070 |
| AAUUAGUAAGACCAUUUAAAAAA | 918 | UUAGUAAGACCAUUUAAAATT | 1114 | UUUUAAAUGGUCUUACUAATT | 1310 | AL-DP-8071 |

TABLE 5-continued

| Target sequence of mRNA from HPV E1 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| AAAAUACUGAAGUGGAAACUCAA | 919 | AAUACUGAAGUGGAAACUCTT | 1115 | GAGUUUCCACUUCAGUAUUTT | 1311 | AL-DP-8072 |
| AAAUACUGAAGUGGAAACUCAAA | 920 | AUACUGAAGUGGAAACUCATT | 1116 | UGAGUUUCCACUUCAGUAUTT | 1312 | AL-DP-8073 |
| AACAAUACUGAAGUGGAAACUAA | 921 | CAAUACUGAAGUGGAAACUTT | 1117 | AGUUUCCACUUCAGUAUUGTT | 1313 | AL-DP-8074 |
| AAUACUGAAGUGGAAACUCAGAA | 922 | UACUGAAGUGGAAACUCAGTT | 1118 | CUGAGUUUCCACUUCAGUATT | 1314 | AL-DP-8075 |
| AAACUGAAGUGGAAACUCAGCAA | 923 | ACUGAAGUGGAAACUCAGCTT | 1119 | GCUGAGUUUCCACUUCAGUTT | 1315 | AL-DP-8076 |
| AACUGAAGUGGAAACUCAGCAAA | 924 | CUGAAGUGGAAACUCAGCATT | 1120 | UGCUGAGUUUCCACUUCAGTT | 1316 | AL-DP-8077 |
| AAUGAAGUGGAAACUCAGCAGAA | 925 | UGAAGUGGAAACUCAGCAGTT | 1121 | CUGCUGAGUUUCCACUUCATT | 1317 | AL-DP-8078 |
| AAGAAGUGGAAACUCAGCAGAAA | 926 | GAAGUGGAAACUCAGCAGATT | 1122 | UCUGCUGAGUUUCCACUUCTT | 1318 | AL-DP-8079 |
| AAAAGUGGAAACUCAGCAGAUAA | 927 | AAGUGGAAACUCAGCAGAUTT | 1123 | AUCUGCUGAGUUUCCACUUTT | 1319 | AL-DP-8080 |
| AAAGUGGAAACUCAGCAGAUGAA | 928 | AGUGGAAACUCAGCAGAUGTT | 1124 | CAUCUGCUGAGUUUCCACUTT | 1320 | AL-DP-8081 |
| AAAUGGCAAUACUGAAGUGGAAA | 929 | AUGGCAAUACUGAAGUGGATT | 1125 | UCCACUUCAGUAUUGCCAUTT | 1321 | AL-DP-8082 |
| AAAAAUCCUUUUUCUCAAGGAAA | 930 | AAAUCCUUUUUCUCAAGGATT | 1126 | UCCUUGAGAAAAGGAUUUTT | 1322 | AL-DP-8083 |
| AAUCCUUUUUCUCAAGGACGUAA | 931 | UCCUUUUUCUCAAGGACGUTT | 1127 | ACGUCCUUGAGAAAAAGGATT | 1323 | AL-DP-8084 |
| AAAUCCUUUUUCUCAAGGACGAA | 932 | AUCCUUUUUCUCAAGGACGTT | 1128 | CGUCCUUGAGAAAAAGGAUTT | 1324 | AL-DP-8085 |
| AAGGCAAUACUGAAGUGGAAAAA | 933 | GGCAAUACUGAAGUGGAAATT | 1129 | UUUCCACUUCAGUAUUGCCTT | 1325 | AL-DP-8086 |
| AACUUUUUCUCAAGGACGUGGAA | 934 | CUUUUUCUCAAGGACGUGGTT | 1130 | CCACGUCCUUGAGAAAAAGTT | 1326 | AL-DP-8087 |
| AACCUUUUUCUCAAGGACGUGAA | 935 | CCUUUUUCUCAAGGACGUGTT | 1131 | CACGUCCUUGAGAAAAAGGTT | 1327 | AL-DP-8088 |
| AAUUUUUCUCAAGGACGUGGUAA | 936 | UUUUUCUCAAGGACGUGGUTT | 1132 | ACCACGUCCUUGAGAAAAATT | 1328 | AL-DP-8089 |
| AAUGGAAAUCCUUUUUCUCAAAA | 937 | UGGAAAUCCUUUUUCUCAATT | 1133 | UUGAGAAAAGGAUUUCCATT | 1329 | AL-DP-8090 |
| AAGGAAAUCCUUUUUCUCAAGAA | 938 | GGAAAUCCUUUUUCUCAAGTT | 1134 | CUUGAGAAAAGGAUUUCCTT | 1330 | AL-DP-8091 |
| AAGAAAUCCUUUUUCUCAAGGAA | 939 | GAAAUCCUUUUUCUCAAGGTT | 1135 | CCUUGAGAAAAGGAUUUCTT | 1331 | AL-DP-8092 |
| AAAAUCCUUUUUCUCAAGGACAA | 940 | AAUCCUUUUUCUCAAGGACTT | 1136 | GUCCUUGAGAAAAGGAUUTT | 1332 | AL-DP-8093 |
| AAUAUGGCAAUACUCAAGUGGAA | 941 | UAUGCCAAUACUGAAGUGGTT | 1137 | CCACUUCAGUAUUGCCAUATT | 1333 | AL-DP-8094 |
| AAUGGCAAUACUGAAGUGGAAAA | 942 | UGGCAAUACUGAAGUGGAATT | 1138 | UUCCACUUCAGUAUUGCCATT | 1334 | AL-DP-8095 |
| AAGCAAUACUGAAGUGGAAACAA | 943 | GCAAUACUGAAGUGGAAACTT | 1139 | GUUUCCACUUCAGUAUUGCTT | 1335 | AL-DP-8096 |
| AAAAUGUGUAGACAUUAUAAAAA | 944 | AAUGUGUAGACAUUAUAAATT | 1140 | UUUAUAAUGUCUACACAUUTT | 1336 | AL-DP-8097 |

Upper case letters: unmodified ribonucleotide (except for T which is an unmodified deoxyribonucleotide)
Lower case letters: ribonucloetide bearing 2'-O-methyl substituent on ribose moiety
s: Indicates position of phosphorothioate internucleoside linkage
chol: cholesterol moiety conjugated to 3' ribonucleotide.
'duplex name' means the name of the composition formed by specific hybridization of the indicated sense strand and the indicated antisense strand.

Testing of siRNA Targeting HPV E1 Gene Expression

Unmodified and chemically modified dsRNA were tested to identify their relative abilities to reduce the expression level of mRNA encoding HPV E1 gene in a cell.

The assay conditions employed were as follows: C33A cells were obtained from ATCC. Sequences encoding HPV16 E6 and E1 were cloned into the pNAS-055 vector (Husken et al., Nucleic Acids Research, 31:e102, 2003), for expression as YFP fusion transcripts. The resulting plasmids were transfected into C33A cells, and stable lines expressing these fusion transcripts were derived by Zeocin selection, as per the manufacturer's protocol (Invitrogen). For transfection with siRNA against HPV16 E6 or HPV16 E1, respective cells were seeded at a density of $2.0 \times 10^4$ cells/well in 96-well plates and transfected directly. Transfection of siRNA (30 nM, 3 nM or 300 pm as indicated) was carried out in a single dose with lipofectamine 2000® (Invitrogen) as described by the manufacturer.

24 hours after transfection cells were lysed and fusion YFP mRNA expression levels were quantified with the Quantigene Explore Kit (Panomics, Inc. (Fremont, Calif.) (formerly Genospectra, Inc.)) using a probe directed against YFP, according to the standard protocol. Fusion-YFP mRNA levels were normalized to GAP-DH mRNA. For each siRNA four individual datapoints were collected. siRNA duplexes unrelated to the HPV16 E1 or E6 genes were used as control. The activity of a given siRNA duplex was expressed as percent fusion-YFP mRNA concentration in treated cells relative to concentration of the same transcript in cells treated with the control siRNA duplex.

Table 6 shows the results of testing the E1 dsRNA of the invention.

| Duplex dsRNA | % mRNA remaining after treatement at 300 pM | S.D. |
|---|---|---|
| ND-9061 | 41.45 | 10.69 |
| ND-9062 | 30.67 | 10.43 |
| ND-9063 | 61.87 | 22.99 |
| ND-9064 | 40.79 | 22.73 |
| ND-9065 | 68.58 | 28.46 |
| ND-9066 | 23.51 | 7.60 |
| ND-9067 | 37.13 | 13.60 |
| ND-9068 | 34.50 | 17.21 |
| ND-9069 | 40.61 | 12.42 |
| ND-9070 | 32.61 | 8.73 |
| ND-9071 | 30.68 | 11.65 |
| ND-9072 | 24.38 | 7.47 |
| ND-9073 | 76.28 | 15.06 |
| ND-9074 | 29.11 | 10.42 |
| ND-9075 | 27.20 | 11.56 |
| ND-9076 | 42.06 | 17.88 |
| ND-9077 | 51.19 | 9.09 |
| ND-9078 | 43.42 | 16.63 |
| ND-9079 | 25.79 | 4.85 |
| ND-9080 | 29.33 | 5.67 |
| ND-9081 | 36.66 | 4.51 |
| ND-9082 | 48.67 | 10.47 |
| ND-9083 | 39.51 | 12.70 |
| ND-9084 | 44.28 | 7.54 |
| ND-9085 | 55.73 | 9.77 |
| ND-9086 | 28.90 | 7.93 |
| ND-9087 | 28.88 | 5.47 |
| ND-9088 | 45.35 | 11.67 |
| ND-9089 | 49.13 | 12.46 |
| ND-9090 | 41.76 | 5.88 |
| ND-9091 | 31.35 | 9.16 |
| ND-9092 | 23.79 | 8.74 |
| ND-9093 | 47.62 | 9.89 |
| ND-9094 | 91.33 | 29.84 |
| ND-9095 | 43.33 | 8.69 |
| ND-9096 | 63.53 | 11.44 |
| ND-9097 | 30.51 | 4.48 |
| ND-9098 | 40.76 | 10.57 |
| ND-9099 | 37.61 | 9.94 |
| ND-9100 | 106.18 | 30.69 |
| ND-9101 | 37.75 | 16.37 |
| ND-9102 | 41.98 | 14.66 |
| ND-9103 | 98.17 | 14.30 |
| ND-9104 | 29.61 | 11.44 |
| ND-9105 | 29.71 | 6.48 |
| ND-9106 | 51.42 | 14.12 |
| ND-9107 | 78.38 | 28.72 |
| ND-9108 | 34.69 | 4.19 |
| ND-9109 | 97.63 | 14.18 |
| ND-9110 | 47.58 | 7.48 |
| ND-9111 | 65.14 | 15.02 |
| ND-9112 | 30.24 | 7.33 |
| ND-9113 | 31.69 | 10.80 |
| ND-9114 | 108.54 | 7.17 |
| ND-9115 | 87.16 | 14.74 |
| ND-9116 | 56.35 | 14.69 |
| ND-9117 | 33.79 | 8.42 |
| ND-9118 | 65.12 | 19.60 |
| ND-9119 | 33.37 | 12.37 |
| ND-9120 | 70.98 | 18.74 |
| ND-9121 | 39.37 | 10.06 |
| ND-9122 | 33.24 | 14.79 |
| ND-9123 | 20.37 | 7.53 |
| ND-9124 | 30.47 | 5.18 |
| ND-9125 | 26.22 | 5.56 |
| ND-9126 | 29.86 | 5.15 |
| ND-9127 | 84.95 | 22.37 |
| ND-9128 | 35.14 | 6.10 |
| ND-9129 | 49.41 | 15.75 |
| ND-9130 | 51.54 | 12.31 |
| ND-9131 | 45.51 | 7.96 |
| ND-9132 | 81.48 | 16.52 |
| ND-9133 | 46.79 | 13.27 |
| ND-9134 | 63.22 | 32.12 |
| ND-9135 | 118.82 | 19.88 |
| ND-9136 | 47.83 | 12.16 |
| ND-9137 | 65.11 | 15.44 |
| ND-9138 | 92.31 | 36.27 |
| ND-9139 | 42.01 | 10.70 |
| ND-9140 | 40.54 | 7.24 |
| ND-9141 | 101.31 | 24.39 |
| ND-9142 | 33.83 | 7.06 |
| ND-9143 | 86.43 | 16.50 |
| ND-9144 | 33.94 | 11.74 |
| ND-9145 | 41.93 | 12.85 |
| ND-9146 | 118.24 | 29.81 |
| ND-9147 | 69.90 | 30.13 |
| ND-9148 | 40.74 | 6.28 |
| ND-9149 | 65.26 | 10.10 |
| ND-9150 | 36.62 | 4.85 |
| ND-9151 | 27.83 | 4.48 |
| ND-9152 | 88.99 | 9.86 |
| ND-9153 | 66.45 | 33.75 |
| ND-9154 | 45.42 | 8.86 |
| ND-9155 | 63.55 | 8.36 |
| ND-9156 | 53.00 | 7.71 |
| ND-9157 | 32.74 | 7.39 |
| ND-9158 | 102.06 | 26.87 |
| ND-9159 | 59.47 | 10.16 |
| ND-9160 | 31.23 | 7.52 |
| ND-9161 | 84.78 | 36.89 |
| ND-9162 | 24.83 | 5.17 |
| ND-9163 | 26.64 | 5.90 |
| ND-9164 | 77.97 | 10.06 |
| ND-9165 | 59.95 | 25.75 |
| ND-9166 | 69.74 | 8.15 |
| ND-9167 | 23.04 | 5.43 |
| ND-9168 | 46.16 | 12.02 |
| ND-9169 | 62.24 | 11.73 |
| ND-9170 | 92.69 | 14.72 |
| ND-9171 | 46.55 | 6.56 |
| ND-9172 | 49.39 | 16.23 |
| ND-9173 | 98.36 | 37.53 |
| ND-9174 | 44.90 | 13.73 |
| ND-9175 | 69.98 | 18.22 |
| ND-9176 | 60.73 | 13.02 |
| ND-9177 | 70.93 | 10.18 |
| ND-9178 | 62.53 | 7.70 |
| ND-9179 | 76.68 | 31.77 |
| ND-9180 | 66.35 | 10.48 |
| ND-9181 | 78.42 | 12.70 |
| ND-9182 | 72.09 | 28.88 |
| ND-9183 | 58.97 | 28.59 |
| ND-9184 | 97.06 | 8.62 |
| ND-9185 | 85.29 | 16.92 |
| ND-9186 | 77.52 | 18.17 |
| ND-9187 | 60.16 | 36.16 |
| ND-9188 | 58.61 | 39.92 |
| ND-9189 | 69.35 | 30.11 |
| ND-9190 | 71.87 | 36.13 |
| ND-9191 | 81.64 | 18.99 |
| ND-9192 | 52.76 | 14.33 |
| ND-9193 | 25.18 | 8.23 |
| ND-9194 | 50.69 | 12.78 |
| ND-9195 | 40.01 | 10.21 |
| ND-9196 | 47.41 | 15.85 |
| ND-9197 | 94.68 | 24.60 |
| ND-9198 | 103.12 | 27.52 |
| ND-9199 | 50.82 | 15.18 |

-continued

| Duplex dsRNA | % mRNA remaining after treatement at 300 pM | S.D. |
|---|---|---|
| ND-9200 | 97.72 | 24.20 |
| AL-DP-8042 | 117.14 | 34.54 |
| AL-DP-8043 | 131.44 | 38.69 |
| AL-DP-8044 | 28.60 | 11.52 |
| AL-DP-8045 | 120.81 | 36.35 |
| AL-DP-8046 | 93.19 | 17.57 |
| AL-DP-8047 | 66.27 | 5.06 |
| AL-DP-8048 | 33.70 | 8.18 |
| AL-DP-8049 | 34.31 | 7.16 |
| AL-DP-8050 | 60.60 | 19.36 |
| AL-DP-8051 | 66.49 | 12.36 |
| AL-DP-8052 | 45.46 | 12.49 |
| AL-DP-8053 | 121.92 | 29.06 |
| AL-DP-8054 | 45.00 | 4.56 |
| AL-DP-8055 | 51.64 | 9.55 |
| AL-DP-8056 | 35.51 | 4.67 |
| AL-DP-8057 | 45.89 | 8.82 |
| AL-DP-8058 | 38.47 | 4.44 |
| AL-DP-8059 | 34.97 | 7.85 |
| AL-DP-8060 | 66.44 | 14.39 |
| AL-DP-8061 | 52.17 | 12.80 |
| AL-DP-8062 | 100.52 | 25.88 |
| AL-DP-8063 | 43.83 | 8.22 |
| AL-DP-8064 | 26.25 | 5.84 |
| AL-DP-8065 | 107.74 | 32.53 |
| AL-DP-8066 | 94.13 | 13.45 |
| AL-DP-8067 | 107.09 | 17.49 |
| AL-DP-8068 | 48.99 | 10.40 |
| AL-DP-8069 | 68.14 | 19.39 |
| AL-DP-8070 | 60.42 | 11.52 |

-continued

| Duplex dsRNA | % mRNA remaining after treatement at 300 pM | S.D. |
|---|---|---|
| AL-DP-8071 | 71.76 | 13.75 |
| AL-DP-8072 | 62.25 | 6.16 |
| AL-DP-8073 | 31.33 | 7.21 |
| AL-DP-8074 | 47.97 | 11.55 |
| AL-DP-8075 | 51.35 | 14.67 |
| AL-DP-8076 | 50.40 | 17.25 |
| AL-DP-8077 | 38.99 | 8.15 |
| AL-DP-8078 | 50.93 | 11.54 |
| AL-DP-8079 | 32.27 | 10.82 |
| AL-DP-8080 | 33.91 | 10.48 |
| AL-DP-8081 | 31.45 | 6.72 |
| AL-DP-8082 | 26.41 | 7.99 |
| AL-DP-8083 | 86.75 | 6.66 |
| AL-DP-8084 | 112.73 | 25.79 |
| AL-DP-8085 | 112.33 | 22.53 |
| AL-DP-8086 | 39.84 | 12.22 |
| AL-DP-8087 | 104.24 | 29.47 |
| AL-DP-8088 | 59.29 | 13.99 |
| AL-DP-8089 | 114.08 | 24.06 |
| AL-DP-8090 | 35.69 | 6.75 |
| AL-DP-8091 | 47.28 | 12.14 |
| AL-DP-8092 | 92.85 | 19.28 |
| AL-DP-8093 | 102.59 | 15.83 |
| AL-DP-8094 | 87.51 | 18.86 |
| AL-DP-8095 | 27.99 | 8.27 |
| AL-DP-8096 | 31.74 | 7.52 |
| AL-DP-8097 | 40.29 | 9.18 |

Design of dsRNA Targeting HPV E6 Gene Expression

Table 7 sets forth dsRNA compositions of the invention.

TABLE 7

| Target sequence of mRNA from HPV E6 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| AAUCGGUGGACCGGUCGAUGUAA | 1336 | UCGGUGGACCGGUCGAUGUTT | 1424 | ACAUCGACCGGUCCACCGATT | 1586 | ND-8899 |
| AAGGUCGGUGGACCGGUCGAUAA | 1337 | GGUCGGUGGACCGGUCGAUTT | 1425 | AUCGACCGGUCCACCGACCTT | 1587 | ND-8900 |
| AACGGUGGACCGGUCGAUGUAAA | 1338 | CGGUGGACCGGUCGAUGUATT | 1426 | UACAUCGACCGGUCCACCGTT | 1588 | ND-8901 |
| AAGUCGGUGGACCGGUCGAUGAA | 1339 | GUCGGUGGACCGGUCGAUGTT | 1427 | CAUCGACCGGUCCACCGACTT | 1589 | ND-8902 |
| AAAUCAUCAAGAACACGUAGAAA | 1340 | AUCAUCAAGAACACGUAGATT | 1428 | UCUACGUGUUCUUGAUGAUTT | 1590 | ND-8903 |
| AACAACAGUUACUGCGACGUGAA | 1341 | CAACAGUUACUGCGACGUGTT | 1429 | CACGUCGCAGUAACUGUUGTT | 1591 | ND-8904 |
| AACAAUACAACAAACCGUUGUAA | 1342 | CAAUACAACAAACCGUUGUTT | 1430 | ACAACGGUUUGUUGUAUUGTT | 1592 | ND-8905 |
| AAGCUGCAAACAACUAUACAUAA | 1343 | GCUGCAAACAACUAUACAUTT | 1431 | AUGUAUAGUUGUUGCAGCTT | 1593 | ND-8906 |
| AAGGUGGACCGGUCGAUGUAUAA | 1344 | GGUGGACCGGUCGAUGUAUTT | 1432 | AUACAUCGACCGGUCCACCTT | 1594 | ND-8907 |
| AAAAAUUAGUGAGUAUAGACAAA | 1345 | AAAUUAGUGAGUAUAGACATT | 1433 | UGUCUAUACUCACUAAUUUTT | 1595 | ND-8908 |
| AAUCAUCAAGAACACGUAGAGAA | 1346 | UCAUCAAGAACACGUAGAGTT | 1434 | CUCUACGUGUUCUUGAUGATT | 1596 | ND-8909 |
| AAAUACAACAAACCGUUGUGUAA | 1347 | AUACAACAAACCGUUGUGUTT | 1435 | ACACAACGGUUUGUUGUAUTT | 1597 | ND-8910 |
| AAUGGACCGGUCGAUGUAUGUAA | 1348 | UGGACCGGUCGAUGUAUGUTT | 1436 | ACAUACAUCGACCGGUCCATT | 1598 | ND-8911 |
| AAUACAACAAACCGUUGUGUGAA | 1349 | UACAACAAACCGUUGUGUGTT | 1437 | CACACAACGGUUUGUUGUATT | 1599 | ND-8912 |
| AAAGAUUCCAUAAUAUAAGGGAA | 1350 | AGAUUCCAUAAUAUAAGGGTT | 1438 | CCCUUAUAUUAUGGAAUCUTT | 1600 | ND-8913 |
| AACAAGCAACAGUUACUGCGAAA | 1351 | CAAGCAACAGUUACUGCGATT | 1439 | UCGCAGUAACUGUUGCUUGTT | 1601 | ND-8914 |
| AAGUUAAUUAGGUGUAUUAACAA | 1352 | GUUAAUUAGGUGUAUUAACTT | 1440 | GUUAAUACACCUAAUUAACTT | 1602 | ND-8915 |

TABLE 7-continued

| Target sequence of mRNA from HPV E6 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| AAUUUGCUUUUCGGGAUUUAUAA | 1353 | UUUGCUUUUCGGGAUUUAUTT | 1441 | AUAAAUCCCGAAAAGCAAATT | 1603 | ND-8916 |
| AAACUUUGCUUUUCGGGAUUUAA | 1354 | ACUUUGCUUUUCGGGAUUUTT | 1442 | AAAUCCCGAAAAGCAAAGUTT | 1604 | ND-8917 |
| AACUGCAAACAACUAUACAUGAA | 1355 | CUGCAAACAACUAUACAUGTT | 1443 | CAUGUAUAGUUGUUUGCAGTT | 1605 | ND-8918 |
| AAAUGACUUUGCUUUUCGGGAAA | 1356 | AUGACUUUGCUUUUCGGGATT | 1444 | UCCCGAAAAGCAAAGUCAUTT | 1606 | ND-8919 |
| AACGACCCAGAAACUUACCACAA | 1357 | CGACCCAGAAAGUUACCACTT | 1445 | GUGGUAACUUUCUGGGUCGTT | 1607 | ND-8920 |
| AAUUACUGCGACGUGAGGUAUAA | 1358 | UUACUGCGACGUGAGGUAUTT | 1446 | AUACCUCACGUCGCAGUAATT | 1608 | ND-8921 |
| AAGUUACUGCGACGUGAGGUAAA | 1359 | GUUACUGCGACGUGAGGUATT | 1447 | UACCUCACGUCGCAGUAACTT | 1609 | ND-8922 |
| AAUGCGACGUGAGGUAUAUGAAA | 1360 | UGCGACGUGAGGUAUAUGATT | 1448 | UCAUAUACCUCACGUCGCATT | 1610 | ND-8923 |
| AAGUCGAUGUAUGUCUUGUUGAA | 1362 | GUCGAUGUAUGUCUUGUUGTT | 1449 | CAACAAGACAUACAUCGACTT | 1611 | ND-8924 |
| AACGACGUGAGGUAUAUGACUAA | 1362 | CGACGUGAGGUAUAUGACUTT | 1450 | AGUCAUAUACCUCACGUCGTT | 1612 | ND-8925 |
| AAGACUUUGCUUUUCGGGAUUAA | 1363 | GACUUUGCUUUUCGGGAUUTT | 1451 | AAUCCCGAAAAGCAAAGUCTT | 1613 | ND-8926 |
| AAUUAGGUGUAUUAACUGUCAAA | 1364 | UUAGGUGUAUUAACUGUCATT | 1452 | UGACAGUUAAUACACCUAATT | 1614 | ND-8927 |
| AAUUACCACAGUUAUGCACAGAA | 1365 | UUACCACAGUUAUGCACAGTT | 1453 | CUGUGCAUAACUGUGGUAATT | 1615 | ND-8928 |
| AAGCAACAGUUACUGCGACGUAA | 1366 | GCAACAGUUACUGCGACGUTT | 1454 | ACGUCGCAGUAACUGUUGCTT | 1616 | ND-8929 |
| AAUGCUUUUCGGGAUUUAUGCAA | 1367 | UGCUUUUCGGGAUUUAUGCTT | 1455 | GCAUAAAUCCCGAAAAGCATT | 1617 | ND-8930 |
| AAUUAGUGAGUAUAGACAUUAAA | 1368 | UUAGUGAGUAUAGACAUUATT | 1456 | UAAUGUCUAUACUCACUAATT | 1618 | ND-8931 |
| AAUAAUUAGGUGUAUUAACUGAA | 1369 | UAAUUAGGUGUAUUAACUGTT | 1457 | CAGUUAAUACACCUAAUUATT | 1619 | ND-8932 |
| AAGAUGUAUGUCUUGUUGCAGAA | 1370 | GAUGUAUGUCUUGUUGCAGTT | 1458 | CUGCAACAAGACAUACAUCTT | 1620 | ND-8933 |
| AACCGGUCGAUGUAUGUCUUGAA | 1371 | CCGGUCGAUGUAUGUCUUGTT | 1459 | CAAGACAUACAUCGACCGGTT | 1621 | ND-8934 |
| AAGGAGCGACCCAGAAAGUUAAA | 1372 | GGAGCGACCCAGAAAGUUATT | 1460 | UAACUUUCUGGGUCGCUCCTT | 1622 | ND-8935 |
| AAGAGCGACCCAGAAAGUUACAA | 1373 | GAGCGACCCAGAAAGUUACTT | 1461 | GUAACUUUCUGGGUCGCUCTT | 1623 | ND-8936 |
| AAUGAGUAUAGACAUUAUUGUAA | 1374 | UGAGUAUAGACAUUAUUGUTT | 1462 | ACAAUAAUGUCUAUAGUCATT | 1624 | ND-8937 |
| AAAAUACAACAAACCGUUGUGAA | 1375 | AAUACAACAAACCGUUGUGTT | 1463 | CACAACGGUUUGUUGUAUUTT | 1625 | ND-8938 |
| AAGUAUGUCUUGUUGCAGAUCAA | 1376 | GUAUGUCUUGUUGCAGAUCTT | 1464 | GAUCUGCAACAAGACAUACTT | 1626 | ND-8939 |
| AACUUUGCUUUUCGGGAUUUAAA | 1377 | CUUUGCUUUUCGGGAUUUATT | 1465 | UAAAUCCdGAAAAGCAAAGTT | 1627 | ND-8940 |
| AAAUUAGUGAGUAUAGACAUUAA | 1378 | AUUAGUGAGUAUACACAUUTT | 1466 | AAUGUCUAUACUCACUAAUTT | 1628 | ND-8941 |
| AAAAGAUUCCAUAAUAUAAGGAA | 1379 | AAGAUUCCAUAAUAUAAGGTT | 1467 | CCUUAUAUUAUGGAAUCUUTT | 1629 | ND-8942 |
| AAGGUCGAUGUAUGUCUUGUUAA | 1380 | GGUCGAUGUAUGUCUUGUUTT | 1468 | AACAAGACAUACAUCGACCTT | 1630 | ND-8943 |
| AACAUCAAGAACACGUAGAGAAA | 1381 | CAUCAAGAACACGUAGAGATT | 1469 | UCUCUACGUGUUCUUGAUGTT | 1631 | ND-8944 |
| AAAACAGUUACUGCGACGUGAAA | 1382 | AACAGUUACUGCGACGUGATT | 1470 | UCACGUCGCAGUAACUGUUTT | 1632 | ND-8945 |
| AAACAGUUACUGCGACGUGAGAA | 1383 | ACAGUUACUGCGACGUGAGTT | 1471 | CUCACGUCGCAGUAACUGUTT | 1633 | ND-8946 |
| AAGUGUGAUUGUUAAUUAGGAA | 1384 | GUGUGAUUUGUUAAUUAGGTT | 1472 | CCUAAUUAACAAAUCACACTT | 1634 | ND-8947 |
| AAUCAAGAACACGUAGAGAAAA | 1385 | AUCAAGAACACGUAGAGAATT | 1473 | UUCUCUACGUGUUCUUGAUTT | 1635 | ND-8948 |
| AAUUUCGGGAUUUAUGCAUAGAA | 1386 | UUUCGGGAUUUAUGCAUAGTT | 1474 | CUAUGCAUAAAUCCCGAAATT | 1636 | ND-8949 |
| AACCCACAGGAGCGACCCAGAA | 1387 | ACCCACAGGAGCGACCCAGTT | 1475 | CUGGGUCGCUCCUGUGGGUTT | 1637 | ND-8950 |
| AAAGAUGGGAAUCCAUAUGCUAA | 1388 | AGAUGGGAAUCCAUAUGCUTT | 1476 | AGCAUAUGGAUUCCCAUCUTT | 1638 | ND-8951 |
| AAUAGUGAGUAUAGACAUUAUAA | 1389 | UAGUGAGUAUAGACAUUAUTT | 1477 | AUAAUGUCUAUACUCACUATT | 1639 | ND-8952 |

TABLE 7-continued

| Target sequence of mRNA from HPV E6 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
| --- | --- | --- | --- | --- | --- | --- |
| AAUGUGUGAUUUGUUAAUUAGAA | 1390 | UGUGUGAUUUGUOAAUUAGTT | 1478 | CUAAUUAACAAAUCACACATT | 1640 | ND-8953 |
| AAUUAAUUAGGUGUAUUAACUAA | 1391 | UUAAUUAGGUGUAUUAACUTT | 1479 | AGUUAAUACACCUAAUUAATT | 1641 | ND-8954 |
| AAAUAUGACUUUGCUUUUCGGAA | 1392 | AUAUGACUUUGCUUUUCGGTT | 1480 | CCGAAAAGCAAAGUCAUAUTT | 1642 | ND-8955 |
| AACGGUCGAUGUAUGUCUUGUAA | 1393 | CGGUCGAUGUAUGUCUUGUTT | 1481 | ACAAGACAUACAUCGACCGTT | 1643 | ND-8956 |
| AACAGGACCCACAGGAGCGACAA | 1394 | CAGGACCCACAGGAGCGACTT | 1482 | GUCGCUCCUGUGGGUCCUGTT | 1644 | ND-8957 |
| AAUUUUCGGGAUUUAUGCAUAAA | 1395 | UUUUCGGGAUUUAUGCAUATT | 1483 | UAUGCAUAAAUCCCGAAAATT | 1645 | ND-8958 |
| AAAAACAACUAUACAUGAUAUAA | 1396 | AAACAACUAUACAUGAUAUTT | 1484 | AUAUCAUGUAUAGUUGUUUTT | 1646 | ND-8959 |
| AAUCCAUAUGCUGUAUGUGAUAA | 1397 | UCCAUAUGCUGUAUGUGAUTT | 1485 | AUCACAUACAGCAUAUGGATT | 1647 | ND-8960 |
| AAUAUUCUAAAAUUAGUGAGUAA | 1398 | UAUUCUAAAAUUAGUGAGUTT | 1486 | ACUCACUAAUUUUAGAAUATT | 1648 | ND-8961 |
| AAUAUGGAACAACAUUAGAACAA | 1399 | UAUGGAACAACAUUAGAACTT | 1487 | GUUCUAAUGUUGUUCCAUATT | 1649 | ND-8962 |
| AAGUCUUGUUGCAGAUCAUCAAA | 1400 | GUCUUGUUGCAGAUCAUCATT | 1488 | UGAUGAUCUGCAACAAGACTT | 1650 | ND-8963 |
| AAUAUUAACUGUCAAAAGCCAAA | 1401 | UAUUAACUGUCAAAAGCCATT | 1489 | UGGCUUUUGACAGUUAAUATT | 1651 | ND-8964 |
| AAACCAAAAGAGAACUGCAAUAA | 1402 | ACCAAAAGAGAACUGCAAUTT | 1490 | AUUGCAGUUCUCUUUUGGTT | 1652 | ND-8965 |
| AAAAUUAGUGAGUAUAGACAUAA | 1403 | AAUUAGUGAGUAUAGACAUTT | 1491 | AUGUCUAUACUCACUAAUUTT | 1653 | ND-8966 |
| AACAGAUCAUCAAGAACACGUAA | 1404 | CAGAUCAUCAAGAACACGUTT | 1492 | ACGUGUUCUUGAUGAUCUGTT | 1654 | ND-8967 |
| AAUAUGCAUAGUAUAUAGAGAAA | 1405 | UAUGCAUAGUAUAUAGAGATT | 1493 | UCUCUAUAUACUAUGCAUATT | 1655 | ND-8968 |
| AAAGAGAUGGGAAUCCAUAUGAA | 1406 | AGAGAUGGGAAUCCAUAUGTT | 1494 | CAUAUGGAUUCCCAUCUCUTT | 1656 | ND-8969 |
| AAAGUGAGUAUAGACAUUAUUAA | 1407 | AGUGAGUAUAGACAUUAUUTT | 1495 | AAUAAUGUCUAUACUCACUTT | 1657 | ND-8970 |
| AAUUCUAAAAUUAGUGAGUAUAA | 1408 | UUCUAAAAUUAGUGAGUAUTT | 1496 | AUACUCACUAAUUUUAGAATT | 1658 | ND-8971 |
| AAAUGCAUAGUAUAUAGAGAUAA | 1409 | AUGCAUAGUAUAUAGAGAUTT | 1497 | AUCUCUAUAUACUAUGCAUTT | 1659 | ND-8972 |
|  |  | ucGGuGGAccGGucGAuGuTsT | 1498 | AcAUCGACCGGUCcACCGATsT | 1660 | ND-8987 |
|  |  | GGucGGuGGAccGGucGAuTsT | 1499 | AUCGACCGGUCcACCGACCTsT | 1661 | ND-8988 |
|  |  | cGGuGGAccGGucGAuGuATsT | 1500 | uAcAUCGACCGGUCcACCGTsT | 1662 | ND-8989 |
|  |  | GucGGuGGAccGGucGAuGTsT | 1501 | cAUCGACCGGUCcACCGACTsT | 1663 | ND-8990 |
|  |  | AucAucAAGAAcAcGuAGATsT | 1502 | UCuACGUGUUCUUGAUGAUTsT | 1664 | ND-8991 |
|  |  | cAAcAGuuAcuGcAcGuGTsT | 1503 | cACGUCGcAGuAACUGUUGTsT | 1665 | ND-8992 |
|  |  | cAAuAcAAcAAAccGuuGuTsT | 1504 | ACAACGGUUUGUUGuAUUGTsT | 1666 | ND-8993 |
|  |  | GcuGcAAAcAAcuAuAcAuTsT | 1505 | AUGuAuAGUUGUUUGcAGCTsT | 1667 | ND-8994 |
|  |  | GGuGGAccGGucGAuGuAuTsT | 1506 | AuAcAUCGACCGGUCCACCTsT | 1668 | ND-8995 |
|  |  | AAAuuAGuGAGuAuAGAcATsT | 1507 | UGUCuAuACUcACuAAUUUTsT | 1669 | ND-8996 |
|  |  | ucAucAAGAAcAcGuAGAGTsT | 1508 | CUCuACGUGUUCUUGAUGATsT | 1670 | ND-8997 |
|  |  | AuAcAAcAAAccGuuGuGuTsT | 1509 | AcAcAACGGUUUGUUGuAUTsT | 1671 | ND-8998 |
|  |  | uGGAccGGucGAuGuAuGuTsT | 1510 | AcAuAcAUCGACCGGUCCATsT | 1672 | ND-8999 |
|  |  | uAcAAcAAAccGuuGuGuGTsT | 1511 | cAcAcAACGGUUUGUUGuATsT | 1673 | ND-9000 |
|  |  | AGAuuccAuAAuAuAAGGGTsT | 1512 | CCCUuAuAUuAUGGAAUCUTsT | 1674 | ND-9001 |
|  |  | cAAGcAAcAGuuAcuGcGATsT | 1513 | UCGcAGuAACUGUUGCUUGTsT | 1675 | ND-9002 |
|  |  | GuuAAuuAGGuGuAuuAAcTsT | 1514 | GUuAAuAcACCuAAUuAACTsT | 1676 | ND-9003 |

TABLE 7-continued

| Target sequence of mRNA from HPV E6 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| | | uuuGcuuuucGGGAuuuAuTsT | 1515 | AuAAAUCCCGAAAAGcAAAUTsT | 1677 | ND-9004 |
| | | AcuuuGcuuuucGGGAuuuTsT | 1516 | AAAUCCCGAAAAGcAAAGUTsT | 1678 | ND-9005 |
| | | cuGcAAAcAAcuAuAcAuGTST | 1517 | cAUGuAuAGUUGUUUGcAGTST | 1679 | ND-9006 |
| | | AuGAcuuuGcuuuucGGGATsT | 1518 | UCCCGAAAAGcAAAGUcAUTsT | 1680 | ND-9007 |
| | | cGAcccAGAAAGuuAccAcTsT | 1519 | GUGGuAACUUUCUGGGUCGTsT | 1681 | ND-9008 |
| | | uuAcuGcGAcGuGAGGuAuTsT | 1520 | AuACCUcACGUCGcAGuAATsT | 1682 | ND-9009 |
| | | GuuAcuGcGAcGuGAGGuATsT | 1521 | uACCUcACGUCGcAGuAACTsT | 1683 | ND-9010 |
| | | uGcGAcGuGAGGuAuAuGATsT | 1522 | UcAuAuACCUcACGUCGcATsT | 1684 | ND-9011 |
| | | GucGAuGuAuGucuuGuuGTsT | 1523 | cAAcAAGAcAuAcAUCGACTsT | 1685 | ND-9012 |
| | | cGAcGuGAGGuAuAUGAcuTsT | 1524 | AGUcAuAuACCUcACGUCGTsT | 1686 | ND-9013 |
| | | GAcuuuGcuuuucGGGAuuTsT | 1525 | AAUCCCGAAAAGcAAAGUCTsT | 1687 | ND-9014 |
| | | uuAGGuGuAuuAAcuGucATsT | 1526 | UGAcAGUuAAuAcACCuAATsT | 1688 | ND-9015 |
| | | uuAccAcAGuuAuGcAcAGTsT | 1527 | CUGUGcAuAACUGUGGuAATsT | 1689 | ND-9016 |
| | | GcAAcAGuuAcUGcAcGuTsT | 1528 | ACGUCGcAGuAACUGUUGCTsT | 1690 | ND-9017 |
| | | uGcuuuucGGGAuuuAuGcTsT | 1529 | GcAuAAAUCCCGAAAAGcATsT | 1691 | ND-9018 |
| | | uuAGuGAGuAuAGAcAuuATsT | 1530 | uAAUGUCuAuACUcACuAATsT | 1692 | ND-9019 |
| | | uAAuuAGGuGuAuuAcuGTsT | 1531 | cAGUuAAuAcACCuAAuATsT | 1693 | ND-9020 |
| | | GAuGuAuGucuuGuuGcAGTsT | 1532 | CUGcAAcAAGAcAuAcAUCTsT | 1694 | ND-9021 |
| | | ccCGucGAuGuAuGucuuGTsT | 1533 | cAAGAcAuAcAUCGACCGGTsT | 1695 | ND-9022 |
| | | GGAGcGAcCCAGAAAGuuATsT | 1534 | uAACUUUCUGGGUCGCUCCTsT | 1696 | ND-9023 |
| | | GAGcGAcccAGAAAGuuAcTsT | 1535 | GuAACUUUCUGGGUCGCUCTsT | 1697 | ND-9024 |
| | | uGAGuAuAGAcAuuAuuGuTsT | 1536 | AcAAuAAUGUCuAuACUcATsT | 1698 | ND-9025 |
| | | AAuAcAAcAAAccGuuGuGTsT | 1537 | cAcAACGGUUUGUUGuAUUTsT | 1699 | ND-9026 |
| | | GuAuGucuuGuuGcAGAucTsT | 1538 | GAUCUGcAAcAAGAcAuACTsT | 1700 | ND-9027 |
| | | cuuuGcuuuucGGGAuuuATsT | 1539 | uAAAUCCCGAAAAGcAAAGTsT | 1701 | ND-9028 |
| | | AuuAGuGAGuAuAGAcAuuTsT | 1540 | AAUGUCuAuACUcACuAAUTsT | 1702 | ND-9029 |
| | | AAGAuuccAuAAuAuAAGGTsT | 1541 | CCUuAuAUuAUGGAAUCUUTsT | 1703 | ND-9030 |
| | | GGucGAuGuAuGucuuGuuTsT | 1542 | AAcAAGAcAuAcAUCGACCTsT | 1704 | ND-9031 |
| | | cAucAAGAAcAcGuAGAGATsT | 1543 | UCUCuACGUGUUCUUGAUGTsT | 1705 | ND-9032 |
| | | AAcAGuuAcuGcGAcGuGATsT | 1544 | UcACGUCGcAGuAACUGUUTsT | 1706 | ND-9033 |
| | | AcAGuuAcuGcGAcGuGAGTsT | 1545 | CUcACGUCGcAGuAACUGUTsT | 1707 | ND-9034 |
| | | GuGuGAuuuGuuAAuuAGGTsT | 1546 | CCuAAUuAAcAAAUcAcACTsT | 1708 | ND-9035 |
| | | AucAAGAAcAcGuAGAGAATsT | 1547 | UUCUCuACGUGUUCUUGAUTsT | 1709 | ND-9036 |
| | | uuucGGGAuuuAuGcAuAGTsT | 1548 | CuAUGcAuAAAUCCCGAAATsT | 1710 | ND-9037 |

TABLE 7-continued

| Target sequence of mRNA from HPV E6 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| | | AcccAcAGGAGcGAcccAGTsT | 1549 | CuGGGUCGCUCCuGuGGGUTsT | 1711 | ND-9038 |
| | | AGAuGGGAAuccAuAuGcuTsT | 1550 | AGcAuAUGGAUUCCcAUCUTsT | 1712 | ND-9039 |
| | | uAGuGAGuAuAGAcAuuAuTsT | 1551 | AuAAUGUCuAuACUcACuATsT | 1713 | ND-9040 |
| | | uGuGuGAuuuGuuAAuuAGTsT | 1552 | CuAAUuAAcAAAUcAcAcATsT | 1714 | ND-9041 |
| | | uuAAuuAGGuGuAuuAAcuTsT | 1553 | AGUuAAuAcACCuAAUuAATsT | 1715 | ND-9042 |
| | | AuAuGAcuuuGcuuuucGGTsT | 1554 | CCGAAAAGcAAAGUcAuAUTsT | 1716 | ND-9043 |
| | | cGGucGAuGuAuGucuuGuTsT | 1555 | AcAAGAcAuAcAUCGACCGTsT | 1717 | ND-9044 |
| | | cAGGAcccAcAGGAGcGAcTsT | 1556 | GUCGCUCCuGuGGGUCCUGTsT | 1718 | ND-9045 |
| | | uuuucGCGAuuuAuGcAuATsT | 1557 | uAUGcAuAAAUCCCGAAAATsT | 1719 | ND-9046 |
| | | AAAcAACuAuAcAuGAuAuTsT | 1558 | AuAUcAUGuAuAGUUGUUUTsT | 1720 | ND-9047 |
| | | uccAuAuGcuGuAuGuGAuTsT | 1559 | AUcAcAuAcAGcAuAUGGATsT | 1721 | ND-9048 |
| | | uAuUcuAAAAuuAGuGAGuTsT | 1560 | ACUCACuAAUUUuAGAAuATsT | 1722 | ND-9049 |
| | | uAuGGAAcAAcAuuAGAAcTsT | 1561 | GUUCuAAUGUUGUUCcAuATsT | 1723 | ND-9050 |
| | | GucuuGuuGcAGAucAucATsT | 1562 | UGAUGAUCUGCAAcAAGACTsT | 1724 | ND-9051 |
| | | uAuuAAcGucAAAAGccATsT | 1563 | UGGCUUUUGACAGUuAAuATsT | 1725 | ND-9052 |
| | | AccAAAAGAGAAcuGcAAuTsT | 1564 | AUUGcAGUUCUCUUUUGGUTsT | 1726 | ND-9053 |
| | | AAuuAGuGAGuAuAGAcAuTsT | 1565 | AUGUCuAuACUcACuAAUUTsT | 1727 | ND-9054 |
| | | cAGAucAucAAGAAcAcGuTsT | 1566 | ACGuGUUCUuGAuGAUCUGTsT | 1728 | ND-9055 |
| | | uAuGCAuAGuAuAuAGAGATsT | 1567 | UCUCuAUAuACuAUGcAuATsT | 1729 | ND-9056 |
| | | AGAGAuGGGAAucCAuAuGTsT | 1568 | cAuAUGGAUUCCcAUCUCUTsT | 1730 | ND-9057 |
| | | AGuGAGuAuAGAcAuuAuuTsT | 1569 | AAuAAUGUCuAuACUcACUTsT | 1731 | ND-9058 |
| | | uucuAAAAuuAGuGAGuAuTsT | 1570 | AuACUcACuAAUUUuAGAATsT | 1732 | ND-9059 |
| | | AuGCAuAGuAuAuAGAGAuTsT | 1571 | AUCUCuAuAuACuAUGcAUTsT | 1733 | ND-9060 |
| AAGUGAUUUGUUAAUUAGGUGAA | 1410 | GUGAUUUGUUAAUUAGGUGTT | 1572 | CACCUAAUUAACAAAUCACTT | 1734 | AL-DP-7778 |
| AAUGAUUUGUUAAUUAGGUGUAA | 1411 | UGAUUUGUUAAUUAGGUGUTT | 1573 | ACACCUAAUUAACAAAUCATT | 1735 | AL-DP-7779 |
| AAGAUUUGUUAAUUAGGUGUAAA | 1412 | GAUUUGUUAAUUAGGUGUATT | 1574 | UACACCUAAUUAACAAAUCTT | 1736 | AL-DP-7780 |
| AAAUUUGUUAAUUAGGUGUAUAA | 1413 | AUUUGUUAAUUAGGUGUAUTT | 1575 | AUACACCUAAUUAACAAAUTT | 1737 | AL-DP-7781 |
| AAUGUGAUUUGUUAAUUAGGUAA | 1414 | UGUGAUUUGUUAAUUAGGUTT | 1576 | ACCUAAUUAACAAAUCACATT | 1738 | AL-DP-7782 |
| AAUGUAUGGAACAACAUUAGAAA | 1415 | UGUAUGGAACAACAUUAGATT | 1577 | UCUAAUGUUGUUCCAUACATT | 1739 | AL-DP-7783 |
| AAGUAUGGAACAACAUUAGAAAA | 1416 | GUAUGGAACAACAUUAGAATT | 1578 | UUCUAAUGUUGUUCCAUACTT | 1740 | AL-DP-7784 |
| AAUGUGUACUGCAAGCAACAGAA | 1417 | UGUGUACUGCAAGCAACAGTT | 1579 | CUGUUGCUUGCAGUACACATT | 1741 | AL-DP-7803 |
| AAACUGCGACGUGAGGUAUAUAA | 1418 | ACUGCGACGUGAGGUAUAUTT | 1580 | AUAUACCUCACGUCGCAGUTT | 1742 | 7804 |
| AAGAGGUAUAUGACUUUGCUUAA | 1419 | GAGGUAUAUGACUUUGCUUTT | 1581 | AAGCAAAGUCAUAUACCUCTT | 1743 | AL-DP-7805 |
| AAAUGCUGUAUGUGAUAAAUGAA | 1420 | AUGCUGUAUGUGAUAAAUGTT | 1582 | CAUUUAUCACAUACAGCAUTT | 1744 | AL-DP-7807 |
| AAUUUAUUCUAAAAUUAGUGAAA | 1421 | UUUAUUCUAAAAUUAGUGATT | 1583 | UCACUAAUUUUAGAAUAAATT | 1745 | AL-DP-7808 |

TABLE 7-continued

| Target sequence of mRNA from HPV E6 reference sequence (sequence of total 19mer target site + AA at both ends) | SEQ ID. NO. | Sense strand (target sequence) having double TT overhang (5'-3') | SEQ ID. NO. | antisense strand (guide sequence) having double TT overhang (5'-3') | SEQ ID. NO. | duplex name |
|---|---|---|---|---|---|---|
| AACUGCGACGUGAGGUAUAUGAA | 1422 | CUGCGACGUGAGGUAUAUGTT | 1584 | CAUAUACCUCACGUCGCAGTT | 1746 | AL-DP-7810 |
| AAACCGUUGUGUGAUUUGUUAAA | 1423 | ACCGUUGUGUGAUUUGUUATT | 1585 | UAACAAAUCACACAACGGUTT | 1747 | AL-DP-7812 |

Upper case letters: unmodified ribonucleotide (except for T which is an unmodified deoxyribonucleotide)
Lower case letters: ribonucloetide bearing 2'-O-methyl substituent on ribose moiety
s: Indicates position of phosphorothioate internucleoside linkage
chol: cholesterol moiety conjugated to 3' ribonucleotide.
'duplex name' means the name of the composition formed by specific hybridization of the indicated sense strand and the indicated antisense strand.

Testing of siRNA Targeting HPV E6 Gene Expression

Unmodified and chemically modified dsRNA were tested to identify their relative abilities to reduce the expression level of mRNA encoding HPV E6 gene in a cell.

The assay conditions employed were as follows: C33A cells were obtained from ATCC. Sequences encoding HPV16 E6 and E1 were cloned into the pNAS-055 vector (Husken et al., Nucleic Acids Research, 31:e102, 2003), for expression as YFP fusion transcripts. The resulting plasmids were transfected into C33A cells, and stable lines expressing these fusion transcripts were derived by Zeocin selection, as per the manufacturer's protocol (Invitrogen). For transfection with siRNA against HPV16 E 6 or HPV16 E1, respective cells were seeded at a density of $2.0 \times 10^4$ cells/well in 96-well plates and transfected directly. Transfection of siRNA (30 nM, 3 nM or 300 pm as indicated) was carried out in a single dose with lipofectamine 20000 (Invitrogen) as described by the manufacturer.

24 hours after transfection cells were lysed and fusion YFP mRNA expression levels were quantified with the Quantigene Explore Kit (Panomics, Inc. (Fremont, Calif.) (formerly Genospectra, Inc.)) using a probe directed against YFP, according to the standard protocol. Fusion-YFP mRNA levels were normalized to GAP-DH mRNA. For each siRNA four individual datapoints were collected. siRNA duplexes-unrelated to the HPV16 E1 or E6 genes were used as control. The activity of a given siRNA duplex was expressed as percent fusion-YFP mRNA concentration in treated cells relative to concentration of the same transcript in cells treated with the control siRNA duplex.

Table 8 shows the results of testing the E6 dsRNA of the invention.

TABLE 8

| duplex name | Mean activity remaining after 30 nM treatment | sd | Mean activity remaining after 300 pM treatment | sd |
|---|---|---|---|---|
| ND-8899 | 15.23 | 3.19 | 31.29 | 9.57 |
| ND-8900 | 11.61 | 2.88 | 26.80 | 10.23 |
| ND-8901 | 10.88 | 3.54 | 24.77 | 5.19 |
| ND-8902 | 20.19 | 7.36 | 43.46 | 6.89 |
| ND-8903 | 10.38 | 2.51 | 22.95 | 5.47 |
| ND-8904 | 13.71 | 4.67 | 22.11 | 5.50 |
| ND-8905 | 13.81 | 4.29 | 24.69 | 4.62 |
| ND-8906 | 8.35 | 2.17 | 24.23 | 6.62 |
| ND-8907 | 13.88 | 3.12 | 36.94 | 6.13 |
| ND-8908 | 14.47 | 3.48 | 45.15 | 7.92 |
| ND-8909 | 19.99 | 3.67 | 49.36 | 9.80 |
| ND-8910 | 36.96 | 9.77 | 74.18 | 15.82 |

TABLE 8-continued

| duplex name | Mean activity remaining after 30 nM treatment | sd | Mean activity remaining after 300 pM treatment | sd |
|---|---|---|---|---|
| ND-8911 | 18.66 | 4.19 | 45.51 | 6.82 |
| ND-8912 | 47.42 | 6.99 | 76.11 | 12.97 |
| ND-8913 | 55.53 | 16.75 | 76.63 | 15.44 |
| ND-8914 | 9.69 | 2.50 | 19.91 | 6.63 |
| ND-8915 | 49.02 | 7.97 | 93.38 | 6.83 |
| ND-8916 | 11.88 | 2.94 | 49.78 | 8.49 |
| ND-8917 | 14.00 | 2.04 | 50.36 | 8.31 |
| ND-8918 | 13.70 | 3.43 | 29.01 | 6.51 |
| ND-8919 | 10.31 | 2.44 | 42.51 | 10.89 |
| ND-8920 | 10.29 | 2.72 | 25.20 | 9.73 |
| ND-8921 | 20.23 | 3.71 | 37.17 | 10.15 |
| ND-8922 | 11.64 | 2.31 | 24.95 | 8.99 |
| ND-8923 | 12.43 | 1.97 | 24.39 | 8.13 |
| ND-8924 | 15.19 | 4.52 | 32.09 | 7.01 |
| ND-8925 | 14.24 | 1.87 | 34.21 | 5.61 |
| ND-8926 | 10.17 | 2.85 | 19.04 | 3.68 |
| ND-8927 | 20.77 | 4.89 | 41.40 | 9.23 |
| ND-8928 | 95.02 | 20.87 | 92.24 | 15.19 |
| ND-8929 | 17.51 | 5.27 | 19.86 | 6.81 |
| ND-8930 | 13.58 | 2.65 | 61.16 | 11.03 |
| ND-8931 | 13.78 | 2.00 | 37.55 | 8.11 |
| ND-8932 | 105.07 | 21.10 | 91.19 | 12.68 |
| ND-8933 | 14.88 | 3.07 | 43.06 | 8.64 |
| ND-8934 | 13.03 | 3.75 | 24.32 | 5.92 |
| ND-8935 | 13.19 | 2.88 | 21.87 | 4.17 |
| ND-8936 | 10.04 | 1.94 | 21.98 | 6.92 |
| ND-8937 | 15.39 | 3.44 | 42.70 | 11.35 |
| ND-8938 | 55.90 | 5.56 | 93.49 | 10.41 |
| ND-8939 | 11.51 | 2.04 | 29.57 | 10.38 |
| ND-8940 | 12.80 | 2.94 | 29.67 | 6.73 |
| ND-8941 | 19.46 | 2.91 | 43.13 | 3.64 |
| ND-8942 | 96.02 | 29.93 | 85.34 | 4.57 |
| ND-8943 | 13.44 | 3.90 | 19.03 | 5.18 |
| ND-8944 | 14.35 | 2.09 | 20.03 | 4.68 |
| ND-8945 | 11.45 | 1.98 | 23.80 | 8.36 |
| ND-8946 | 15.43 | 2.27 | 43.12 | 13.34 |
| ND-8947 | 13.32 | 2.20 | 53.58 | 18.04 |
| ND-8948 | 12.85 | 3.18 | 23.22 | 6.79 |
| ND-8949 | 86.23 | 23.43 | 75.99 | 7.17 |
| ND-8950 | 29.49 | 7.99 | 47.19 | 14.70 |
| ND-8951 | 10.51 | 2.85 | 20.21 | 6.23 |
| ND-8952 | 12.10 | 2.74 | 28.82 | 9.06 |
| ND-8953 | 41.13 | 11.23 | 77.64 | 9.46 |

TABLE 8-continued

| duplex name | Mean activity remaining after 30 nM treatment | sd | Mean activity remaining after 300 pM treatment | sd |
|---|---|---|---|---|
| ND-8954 | 46.52 | 8.41 | 81.61 | 14.93 |
| ND-8955 | 38.40 | 8.46 | 83.38 | 16.32 |
| ND-8956 | 12.13 | 2.23 | 21.94 | 9.54 |
| ND-8957 | 28.39 | 6.18 | 53.84 | 12.53 |
| ND-8958 | 36.41 | 9.92 | 55.67 | 8.77 |
| ND-8959 | 33.95 | 11.23 | 63.63 | 5.53 |
| ND-8960 | 13.63 | 2.39 | 26.49 | 9.24 |
| ND-8961 | 80.42 | 18.39 | 89.13 | 8.61 |
| ND-8962 | 33.00 | 4.18 | 82.57 | 9.01 |
| ND-8963 | 16.67 | 1.85 | 28.39 | 9.50 |
| ND-8964 | 14.17 | 2.58 | 43.74 | 14.37 |
| ND-8965 | 17.23 | 5.15 | 48.03 | 10.97 |
| ND-8966 | 23.01 | 5.10 | 53.86 | 10.10 |
| ND-8967 | 18.68 | 5.13 | 23.30 | 6.20 |
| ND-8968 | 10.99 | 1.83 | 28.22 | 9.33 |
| ND-8969 | 13.75 | 2.67 | 32.62 | 10.53 |
| ND-8970 | 11.02 | 2.68 | 29.14 | 10.73 |
| ND-8971 | 21.71 | 3.11 | 57.75 | 10.54 |
| ND-8972 | 17.10 | 3.20 | 52.10 | 10.84 |
| ND-8987 | 40.36 | 7.25 | 91.12 | 9.07 |
| ND-8988 | 20.54 | 5.27 | 30.76 | 12.23 |
| ND-8989 | 36.60 | 7.23 | 74.41 | 8.61 |
| ND-8990 | 17.55 | 8.33 | 61.02 | 11.13 |
| ND-8991 | 11.29 | 2.87 | 19.03 | 5.98 |
| ND-8992 | 14.49 | 3.37 | 44.53 | 14.74 |
| ND-8993 | 18.45 | 5.75 | 48.07 | 6.79 |
| ND-8994 | 13.16 | 1.80 | 25.92 | 7.94 |
| ND-8995 | 52.21 | 5.93 | 90.43 | 4.86 |
| ND-8996 | 32.77 | 6.96 | 57.54 | 7.12 |
| ND-8997 | 14.45 | 1.50 | 20.63 | 4.28 |
| ND-8998 | 137.83 | 33.37 | 90.09 | 14.65 |
| ND-8999 | 82.01 | 13.74 | 85.69 | 10.39 |
| ND-9000 | 69.77 | 21.32 | 83.16 | 14.34 |
| ND-9001 | 54.71 | 18.91 | 74.70 | 8.87 |
| ND-9002 | 12.15 | 2.05 | 22.98 | 6.98 |
| ND-9003 | 76.52 | 11.49 | 98.54 | 7.10 |
| ND-9004 | 62.23 | 16.29 | 84.38 | 8.22 |
| ND-9005 | 38.12 | 6.77 | 64.57 | 6.57 |
| ND-9006 | 12.96 | 3.15 | 26.03 | 4.76 |
| ND-9007 | 18.24 | 4.88 | 42.16 | 7.87 |
| ND-9008 | 21.06 | 4.60 | 20.01 | 6.00 |
| ND-9009 | 35.15 | 5.62 | 79.96 | 7.01 |
| ND-9010 | 13.71 | 2.83 | 53.80 | 12.21 |
| ND-9011 | 38.04 | 3.56 | 60.45 | 10.19 |
| ND-9012 | 44.63 | 37.28 | 67.30 | 8.30 |
| ND-9013 | 13.31 | 1.81 | 31.12 | 6.40 |
| ND-9014 | 12.69 | 3.66 | 27.50 | 7.48 |
| ND-9015 | 16.26 | 3.61 | 21.18 | 4.80 |
| ND-9016 | 29.49 | 8.14 | 66.50 | 15.07 |
| ND-9017 | 16.98 | 2.22 | 27.17 | 7.64 |
| ND-9018 | 35.62 | 7.31 | 86.49 | 7.60 |
| ND-9019 | 23.48 | 2.57 | 60.66 | 13.05 |
| ND-9020 | 113.04 | 21.57 | 88.75 | 12.94 |
| ND-9021 | 38.45 | 5.44 | 68.21 | 9.53 |
| ND-9022 | 14.21 | 2.86 | 53.78 | 13.38 |
| ND-9023 | 21.84 | 3.72 | 41.95 | 11.93 |
| ND-9024 | 117.68 | 33.94 | 86.00 | 6.55 |
| ND-9025 | 86.38 | 19.82 | 81.09 | 9.82 |
| ND-9026 | 113.52 | 9.02 | 95.62 | 10.60 |
| ND-9027 | 13.61 | 2.09 | 51.98 | 15.63 |
| ND-9028 | 14.49 | 4.02 | 45.08 | 11.80 |
| ND-9029 | 20.16 | 3.25 | 39.00 | 8.28 |
| ND-9030 | 104.95 | 34.72 | 76.74 | 10.03 |
| ND-9031 | 19.90 | 6.09 | 26.32 | 9.90 |
| ND-9032 | 16.43 | 3.38 | 19.10 | 5.44 |
| ND-9033 | 100.99 | 24.54 | 86.16 | 11.95 |
| ND-9034 | 13.77 | 2.84 | 33.36 | 13.56 |
| ND-9035 | 13.54 | 1.58 | 57.07 | 19.24 |
| ND-9036 | 12.91 | 3.20 | 21.78 | 6.03 |
| ND-9037 | 30.90 | 8.30 | 74.12 | 12.35 |
| ND-9038 | 121.49 | 24.79 | 87.65 | 7.07 |
| ND-9039 | 10.19 | 3.13 | 23.32 | 9.60 |
| ND-9040 | 11.45 | 2.34 | 22.86 | 8.27 |
| ND-9041 | 33.73 | 8.63 | 82.99 | 13.62 |
| ND-9042 | 18.21 | 3.81 | 60.07 | 13.85 |
| ND-9043 | 36.15 | 3.87 | 71.81 | 12.23 |
| ND-9044 | 13.77 | 3.59 | 30.27 | 10.81 |
| ND-9045 | 56.81 | 19.55 | 85.99 | 9.99 |
| ND-9046 | 26.03 | 6.18 | 51.21 | 10.14 |
| ND-9047 | 100.23 | 24.53 | 85.98 | 5.59 |
| ND-9048 | 21.82 | 4.07 | 44.44 | 12.82 |
| ND-9049 | 82.93 | 21.46 | 87.79 | 7.07 |
| ND-9050 | 18.51 | 3.33 | 40.70 | 10.96 |
| ND-9051 | 22.80 | 3.37 | 42.44 | 14.86 |
| ND-9052 | 12.61 | 3.78 | 37.58 | 13.35 |
| ND-9053 | 19.88 | 4.32 | 53.11 | 3.23 |
| ND-9054 | 33.65 | 8.32 | 59.71 | 6.42 |
| ND-9055 | 22.61 | 7.41 | 27.44 | 7.04 |
| ND-9056 | 16.61 | 3.38 | 34.34 | 13.22 |
| ND-9057 | 25.51 | 6.29 | 51.45 | 10.10 |
| ND-9058 | 27.60 | 4.56 | 54.99 | 13.52 |
| ND-9059 | 23.83 | 4.36 | 84.76 | 13.88 |
| ND-9060 | 17.12 | 3.29 | 44.54 | 15.68 |
| AL-DP-7778 | 19.35 | 8.95 | 63.31 | 14.21 |
| AL-DP-7779 | 41.30 | 9.51 | 65.96 | 7.82 |
| AL-DP-7780 | 24.01 | 7.52 | 59.43 | 8.85 |
| AL-DP-7781 | 13.69 | 3.41 | 53.58 | 9.31 |
| AL-DP-7782 | 31.35 | 5.31 | 65.84 | 10.41 |
| AL-DP-7783 | 14.46 | 2.85 | 38.92 | 10.30 |
| AL-DP-7784 | 13.52 | 1.52 | 25.09 | 7.89 |
| AL-DP-7803 | 39.68 | 4.75 | 66.72 | 11.32 |
| 7804 | 12.56 | 3.96 | 26.81 | 6.28 |
| AL-DP-7805 | 13.92 | 2.22 | 35.87 | 8.95 |
| AL-DP-7807 | 35.54 | 4.95 | 70.94 | 11.01 |
| AL-DP-7808 | 81.47 | 9.77 | 96.18 | 10.87 |
| AL-DP-7810 | 15.14 | 2.12 | 37.66 | 16.19 |
| AL-DP-7812 | 12.89 | 1.99 | 25.18 | 12.05 |

Those skilled in the art are familiar with methods and compositions in addition to those specifically set out in the instant disclosure which will allow them to practice this invention to the full scope of the claims hereinafter appended.

SEQUENCE LISTING (1750 sequences)

SEQ ID NO: 1 - RNA, 23 nt, Artificial sequence
  Synthetic sequence: Target sequence of mRNA from human reference sequence NM_130838 (human iso3); sequence of total 19mer target site + aa at ends
aaauacgaugaaucuacaaaaaa

SEQ ID NO: 2 - RNA, 23 nt, Artificial sequence
  Synthetic sequence: Target sequence of mRNA from human reference sequence NM_130838 (human iso3); sequence of total 19mer target site + aa at ends
aaugacuacauucucaauaaaaa

SEQ ID NO: 3 - RNA, 23 nt, Artificial sequence
  Synthetic sequence: Target sequence of mRNA from human reference sequence NM_130838 (human iso3); sequence of total 19mer target site + aa at ends
aaagccugcacgaaugaguuuaa

SEQ ID NO: 4 - RNA, 23 nt, Artificial sequence
  Synthetic sequence: Target sequence of mRNA from human reference sequence NM_130838 (human iso3); sequence of total 19mer target site + aa at ends
aaggauugucgaaaaccacuuaa

SEQ ID NO: 5 - RNA, 23 nt, Artificial sequence
  Synthetic sequence: Target sequence of mRNA from human reference sequence NM_130838 (human iso3); sequence of total 19mer target site + aa at ends
aacucucgagauccuaauuauaa

SEQ ID NO: 6 - RNA, 23 nt, Artificial sequence
  Synthetic sequence: Target sequence of mRNA from human reference sequence NM_130838 (human iso3); sequence of total 19mer target site + aa at ends
aaaugugacuuacuuaacagaaa

SEQ ID NO: 7 - RNA, 23 nt, Artificial sequence
  Synthetic sequence: Target sequence of mRNA from human reference sequence NM_130838 (human iso3); sequence of total 19mer target site + aa at ends
aaguauacucucgagauccuaaa

SEQ ID NO: 8 - RNA, 23 nt, Artificial sequence
  Synthetic sequence: Target sequence of mRNA from human reference sequence NM_130838 (human iso3); sequence of total 19mer target site + aa at ends
aaagguuaccuacaucucauaaa

SEQ ID NO: 9 - RNA, 23 nt, Artificial sequence
  Synthetic sequence: Target sequence of mRNA from human reference sequence NM_130838 (human iso3); sequence of total 19mer target site + aa at ends
aaaguacuuauucagaccagaaa

SEQ ID NO: 10 - RNA, 23 nt, Artificial sequence
  Synthetic sequence: Target sequence of mRNA from human reference sequence NM_130838 (human iso3); sequence of total 19mer target site + aa at ends
aaauccuaauuaucugaauuuaa

SEQ ID NO: 11 - RNA, 23 nt, Artificial sequence
  Synthetic sequence: Target sequence of mRNA from human reference sequence NM_130838 (human iso3); sequence of total 19mer target site + aa at ends
aaaaggauaggugauagcucaaa

SEQ ID NO: 12 - RNA, 23 nt, Artificial sequence
  Synthetic sequence: Target sequence of mRNA from human reference sequence NM_130838 (human iso3); sequence of total 19mer target site + aa at ends
aaggaagccggaaucuagauuaa

SEQ ID NO: 13 - RNA, 23 nt, Artificial sequence
  Synthetic sequence: Target sequence of mRNA from human reference sequence NM_130838 (human iso3); sequence of total 19mer target site + aa at ends
aaugcuucgaagugcuugaaaaa

SEQ ID NO: 14 - RNA, 23 nt, Artificial sequence
  Synthetic sequence: Target sequence of mRNA from human reference sequence NM_130838 (human iso3); sequence of total 19mer target site + aa at ends
aauggauugucgaaaaccacuaa

SEQ ID NO: 15 - RNA, 23 nt, Artificial sequence
  Synthetic sequence: Target sequence of mRNA from human reference sequence NM_130838 (human iso3); sequence of total 19mer target site + aa at ends
aacggcuagagaugaucgcuaaa

SEQ ID NO: 16 - RNA, 23 nt, Artificial sequence
  Synthetic sequence: Target sequence of mRNA from human reference sequence NM_130838 (human iso3); sequence of total 19mer target site + aa at ends
aaacagucgaaaucuagugaaaa

SEQ ID NO: 17 - RNA, 23 nt, Artificial sequence
  Synthetic sequence: Target sequence of mRNA from human reference sequence NM_130838 (human iso3); sequence of total 19mer target site + aa at ends
aagaucagacuguggucuaaaaa

SEQ ID NO: 18 - RNA, 23 nt, Artificial sequence
  Synthetic sequence: Target sequence of mRNA from human reference sequence NM_130838 (human iso3); sequence of total 19mer target site + aa at ends
aacucgagauccuaauuaucuaa

SEQ ID NO: 19 - RNA, 23 nt, Artificial sequence
  Synthetic sequence: Target sequence of mRNA from human reference sequence NM_130838 (human iso3); sequence of total 19mer target site + aa at ends
aauaucguaauggagaauagaaa

SEQ ID NO: 20 - RNA, 23 nt, Artificial sequence
  Synthetic sequence: Target sequence of mRNA from human reference sequence NM_130838 (human iso3); sequence of total 19mer target site + aa at ends
aacucaaaguuagacgugaccaa

SEQ ID NO: 21 - RNA, 23 nt, Artificial sequence
  Synthetic sequence: Target sequence of mRNA from human reference sequence NM_130838 (human iso3); sequence of total 19mer target site + aa at ends
aaaggauaggugauagcucacaa

SEQ ID NO: 22 - RNA, 23 nt, Artificial sequence
  Synthetic sequence: Target sequence of mRNA from human reference sequence NM_130838 (human iso3); sequence of total 19mer target site + aa at ends
aacaccuaacguggaaugugaaa

SEQ ID NO: 23 - RNA, 23 nt, Artificial sequence
  Synthetic sequence: Target sequence of mRNA from human reference sequence NM_130838 (human iso3); sequence of total 19mer target site + aa at ends
aaaaucguucauucauuuacaaa

SEQ ID NO: 24 - RNA, 23 nt, Artificial sequence
  Synthetic sequence: Target sequence of mRNA from human reference sequence NM_130838 (human iso3); sequence of total 19mer target site + aa at ends
aacuugacguaucacaauguaaa

SEQ ID NO: 25 - RNA, 23 nt, Artificial sequence
  Synthetic sequence: Target sequence of mRNA from human reference sequence NM_130838 (human iso3); sequence of total 19mer target site + aa at ends
aaugguauguucacauacgauaa

SEQ ID NO: 26 - RNA, 23 nt, Artificial sequence
  Synthetic sequence: Target sequence of mRNA from human reference sequence NM_130838 (human iso3); sequence of total 19mer target site + aa at ends
aagauaggugauagcucacagaa

SEQ ID NO: 27 - RNA, 23 nt, Artificial sequence
  Synthetic sequence: Target sequence of mRNA from human reference sequence NM_130838 (human iso3); sequence of total 19mer target site + aa at ends
aaccggcuagagaugaucgcuaa

SEQ ID NO: 28 - RNA, 23 nt, Artificial sequence
  Synthetic sequence: Target sequence of mRNA from human reference sequence NM_130838 (human iso3); sequence of total 19mer target site + aa at ends
aacauaguacugggucuggcuaa

SEQ ID NO: 29 - RNA, 23 nt, Artificial sequence
  Synthetic sequence: Target sequence of mRNA from human reference sequence NM_130838 (human iso3); sequence of total 19mer target site + aa at ends
aaaauguauacucucgagaucaa

SEQ ID NO: 30 - RNA, 23 nt, Artificial sequence
  Synthetic sequence: Target sequence of mRNA from human reference sequence NM_130838 (human iso3); sequence of total 19mer target site + aa at ends
aaaacuuuucgugacuugggaaa

SEQ ID NO: 31 - RNA, 23 nt, Artificial sequence
  Synthetic sequence: Target sequence of mRNA from human reference sequence NM_130838 (human iso3); sequence of total 19mer target site + aa at ends
aaaaaguuagacgugaccauaaa

SEQ ID NO: 32 - RNA, 23 nt, Artificial sequence
  Synthetic sequence: Target sequence of mRNA from human reference sequence NM_130838 (human iso3); sequence of total 19mer target site + aa at ends
aaugauuagggaguucugggaaa

SEQ ID NO: 33 - RNA, 23 nt, Artificial sequence
  Synthetic sequence: Target sequence of mRNA from human reference sequence NM_130838 (human iso3); sequence of total 19mer target site + aa at ends
aauacgaugaaucuacaaaauaa

SEQ ID NO: 34 - RNA, 23 nt, Artificial sequence
  Synthetic sequence: Target sequence of mRNA from human reference sequence NM_130838 (human iso3); sequence of total 19mer target site + aa at ends
aacuuguccggcuagagaugaaa

SEQ ID NO: 35 - RNA, 23 nt, Artificial sequence
  Synthetic sequence: Target sequence of mRNA from human reference sequence NM_130838 (human iso3); sequence of total 19mer target site + aa at ends
aauauacucucgagauccuaaaa

SEQ ID NO: 36 - RNA, 23 nt, Artificial sequence
  Synthetic sequence: Target sequence of mRNA from human reference sequence NM_130838 (human iso3); sequence of total 19mer target site + aa at ends
aaacuugacguaucacaauguaa

SEQ ID NO: 37 - RNA, 23 nt, Artificial sequence
  Synthetic sequence: Target sequence of mRNA from human reference sequence NM_130838 (human iso3); sequence of total 19mer target site + aa at ends
aaaacagucgaaaucuagugaaa

SEQ ID NO: 38 - RNA, 23 nt, Artificial sequence
  Synthetic sequence: Target sequence of mRNA from human reference sequence NM_130838 (human iso3); sequence of total 19mer target site + aa at ends
aaucauuaucguaauggagaaaa

SEQ ID NO: 39 - RNA, 23 nt, Artificial sequence
  Synthetic sequence: Target sequence of mRNA from human reference sequence NM_130838 (human iso3); sequence of total 19mer target site + aa at ends
aaauaguacugggucuggcuaaa

SEQ ID NO: 40 - RNA, 23 nt, Artificial sequence
  Synthetic sequence: Target sequence of mRNA from human reference sequence NM_130838 (human iso3); sequence of total 19mer target site + aa at ends
aaccuaacguggaaugugacuaa

SEQ ID NO: 41 - RNA, 23 nt, Artificial sequence
  Synthetic sequence: Target sequence of mRNA from human reference sequence NM_130838 (human iso3); sequence of total 19mer target site + aa at ends
aauuguccggcuagagaugauaa

SEQ ID NO: 42 - RNA, 23 nt, Artificial sequence
  Synthetic sequence: Target sequence of mRNA from human reference sequence NM_130838 (human iso3); sequence of total 19mer target site + aa at ends
aaaccuaacguggaaugugacaa

SEQ ID NO: 43 - RNA, 23 nt, Artificial sequence
  Synthetic sequence: Target sequence of mRNA from human reference sequence NM_130838 (human iso3); sequence of total 19mer target site + aa at ends
aauuaacagucgaaaucuaguaa

SEQ ID NO: 44 - RNA, 23 nt, Artificial sequence
  Synthetic sequence: Target sequence of mRNA from human reference sequence NM_130838 (human iso3); sequence of total 19mer target site + aa at ends
aauuggcauaguacugggucuaa

SEQ ID NO: 45 - RNA, 23 nt, Artificial sequence
  Synthetic sequence: Target sequence of mRNA from human reference sequence NM_130838 (human iso3); sequence of total 19mer target site + aa at ends
aagaacuuuucgugacuugggaa

SEQ ID NO: 46 - RNA, 23 nt, Artificial sequence
  Synthetic sequence: Target sequence of mRNA from human reference sequence NM_130838 (human iso3); sequence of total 19mer target site + aa at ends
aaguccggcuagagaugaucgaa

SEQ ID NO: 47 - RNA, 23 nt, Artificial sequence
  Synthetic sequence: Target sequence of mRNA from human reference sequence NM_130838 (human iso3); sequence of total 19mer target site + aa at ends
aagcccucgagcuuuauaagaaa

SEQ ID NO: 48 - RNA, 23 nt, Artificial sequence
  Synthetic sequence: Target sequence of mRNA from human reference sequence NM_130838 (human iso3); sequence of total 19mer target site + aa at ends
aacucgagcuuuauaagauuaaa

SEQ ID NO: 49 - RNA, 23 nt, Artificial sequence
  Synthetic sequence: Target sequence of mRNA from human reference sequence NM_130838 (human iso3); sequence of total 19mer target site + aa at ends
aauggcauaguacugggucugaa

SEQ ID NO: 50 - RNA, 23 nt, Artificial sequence
  Synthetic sequence: Target sequence of mRNA from human reference sequence NM_130838 (human iso3); sequence of total 19mer target site + aa at ends
aaacgaaugaguuuugugcuuaa

SEQ ID NO: 51 - RNA, 23 nt, Artificial sequence
  Synthetic sequence: Target sequence of mRNA from human reference sequence NM_130838 (human iso3); sequence of total 19mer target site + aa at ends
aauuucuucguauggauaauaaa

SEQ ID NO: 52 - RNA, 23 nt, Artificial sequence
  Synthetic sequence: Target sequence of mRNA from human reference sequence NM_130838 (human iso3); sequence of total 19mer target site + aa at ends
aaagacgugaccauaucauagaa

SEQ ID NO: 53 - RNA, 23 nt, Artificial sequence
  Synthetic sequence: Target sequence of mRNA from human reference sequence NM_130838 (human iso3); sequence of total 19mer target site + aa at ends
aauaguacugggucuggcuauaa

SEQ ID NO: 54 - RNA, 23 nt, Artificial sequence
  Synthetic sequence: Target sequence of mRNA from human reference sequence NM_130838 (human iso3); sequence of total 19mer target site + aa at ends
aacguauggauaauaaugcagaa

SEQ ID NO: 55 - RNA, 23 nt, Artificial sequence
  Synthetic sequence: Target sequence of mRNA from human reference sequence NM_130838 (human iso3); sequence of total 19mer target site + aa at ends
aauggcuauuuacaauaacugaa

SEQ ID NO: 56 - RNA, 23 nt, Artificial sequence
  Synthetic sequence: Target sequence of mRNA from human reference sequence NM_130838 (human iso3); sequence of total 19mer target site + aa at ends
aaaauucgcauguacagugaaaa

SEQ ID NO: 57 - RNA, 23 nt, Artificial sequence
  Synthetic sequence: Target sequence of mRNA from human reference sequence NM_130838 (human iso3); sequence of total 19mer target site + aa at ends
aaaauagaauucgcauguacaaa

SEQ ID NO: 58 - RNA, 23 nt, Artificial sequence
  Synthetic sequence: Target sequence of mRNA from human reference sequence NM_130838 (human iso3); sequence of total 19mer target site + aa at ends
aaugguaacccaaugauguauaa

SEQ ID NO: 59 - RNA, 23 nt, Artificial sequence
  Synthetic sequence: Target sequence of mRNA from human reference sequence NM_130838 (human iso3); sequence of total 19mer target site + aa at ends
aaagccggaaucuagauuuccaa

SEQ ID NO: 60 - RNA, 23 nt, Artificial sequence
  Synthetic sequence: Target sequence of mRNA from human reference sequence NM_130838 (human iso3); sequence of total 19mer target site + aa at ends
aaacuuuucgugacuugggagaa

SEQ ID NO: 61 - RNA, 23 nt, Artificial sequence
  Synthetic sequence: Target sequence of mRNA from human reference sequence NM_130838 (human iso3); sequence of total 19mer target site + aa at ends
aaagcccucgagcuuuauaagaa

SEQ ID NO: 62 - RNA, 23 nt, Artificial sequence
  Synthetic sequence: Target sequence of mRNA from human reference sequence NM_130838 (human iso3); sequence of total 19mer target site + aa at ends
aagaacgaagaaucacuguucaa

SEQ ID NO: 63 - RNA, 23 nt, Artificial sequence
  Synthetic sequence: Target sequence of mRNA from human reference sequence NM_130838 (human iso3); sequence of total 19mer target site + aa at ends
aauauucugacuacauucucaaa

SEQ ID NO: 64 - RNA, 23 nt, Artificial sequence
  Synthetic sequence: Target sequence of mRNA from human reference sequence NM_130838 (human iso3); sequence of total 19mer target site + aa at ends
aagcaucuaauagaacgcuacaa

SEQ ID NO: 65 - RNA, 23 nt, Artificial sequence
  Synthetic sequence: Target sequence of mRNA from human reference sequence NM_130838 (human iso3); sequence of total 19mer target site + aa at ends
aaucgaaaucuagugaaugauaa

SEQ ID NO: 66 - RNA, 23 nt, Artificial sequence
  Synthetic sequence: Target sequence of mRNA from human reference sequence NM_130838 (human iso3); sequence of total 19mer target site + aa at ends
aaagucgaaaucuagugaaugaa

SEQ ID NO: 67 - RNA, 23 nt, Artificial sequence
  Synthetic sequence: Target sequence of mRNA from human reference sequence NM_130838 (human iso3); sequence of total 19mer target site + aa at ends
aagaaaggcgcuagaauugauaa

SEQ ID NO: 68 - RNA, 23 nt, Artificial sequence
  Synthetic sequence: Target sequence of mRNA from human reference sequence NM_130838 (human iso3); sequence of total 19mer target site + aa at ends
aaaaaggcgcuagaauugauuaa

SEQ ID NO: 69 - RNA, 23 nt, Artificial sequence
  Synthetic sequence: Target sequence of mRNA from human reference sequence NM_130838 (human iso3); sequence of total 19mer target site + aa at ends
aaaggcgcuagaauugauuuuaa

SEQ ID NO: 70 - RNA, 23 nt, Artificial sequence
  Synthetic sequence: Target sequence of mRNA from human reference sequence NM_130838 (human iso3); sequence of total 19mer target site + aa at ends
aaagcaucuaauagaacgcuaaa

SEQ ID NO: 71 - RNA, 23 nt, Artificial sequence
  Synthetic sequence: Target sequence of mRNA from human reference sequence NM_130838 (human iso3); sequence of total 19mer target site + aa at ends
aacaaagcgaugagcaagcuaaa

SEQ ID NO: 72 - RNA, 23 nt, Artificial sequence
  Synthetic sequence: Target sequence of mRNA from human reference sequence NM_130838 (human iso3); sequence of total 19mer target site + aa at ends
aaccaugguugucuacaggaaaa

SEQ ID NO: 73 - RNA, 23 nt, Artificial sequence
  Synthetic sequence: Target sequence of mRNA from human reference sequence NM_130838 (human iso3); sequence of total 19mer target site + aa at ends
aaagaaaggcgcuagaauugaaa

SEQ ID NO: 74 - RNA, 23 nt, Artificial sequence
  Synthetic sequence: Target sequence of mRNA from human reference sequence NM_130838 (human iso3); sequence of total 19mer target site + aa at ends
aaaacgcuacuaccaccaguuaa

SEQ ID NO: 75 - RNA, 23 nt, Artificial sequence
  Synthetic sequence: Target sequence of mRNA from human reference sequence NM_130838 (human iso3); sequence of total 19mer target site + aa at ends
aagcgcuagaauugauuuuaaaa

SEQ ID NO: 76 - RNA, 23 nt, Artificial sequence
  Synthetic sequence: Target sequence of mRNA from human reference sequence NM_130838 (human iso3); sequence of total 19mer target site + aa at ends
aagcacgugaucaguguugcaaa

SEQ ID NO: 77 - RNA, 23 nt, Artificial sequence
  Synthetic sequence: Target sequence of mRNA from human reference sequence NM_130838 (human iso3); sequence of total 19mer target site + aa at ends
aagauagugucccaguacaaaaa

SEQ ID NO: 78 - RNA, 23 nt, Artificial sequence
  Synthetic sequence: Target sequence of mRNA from human reference sequence NM_130838 (human iso3); sequence of total 19mer target site + aa at ends
aauuugcgugaaaguguuacaaa

SEQ ID NO: 79 - RNA, 23 nt, Artificial sequence
  Synthetic sequence: Target sequence of mRNA from human reference sequence NM_130838 (human iso3); sequence of total 19mer target site + aa at ends
aaaguaugugcuacuuuuuugaa

SEQ ID NO: 80 - RNA, 23 nt, Artificial sequence
  Synthetic sequence: Target sequence of mRNA from human reference sequence NM_130838 (human iso3); sequence of total 19mer target site + aa at ends
aaguaugucgucuucauguguaa

SEQ ID NO: 81 - RNA, 23 nt, Artificial sequence
  Synthetic sequence: Target sequence of mRNA from human reference sequence NM_130838 (human iso3); sequence of total 19mer target site + aa at ends
aagguagucaagccuauugcaaa

SEQ ID NO: 82 - RNA, 23 nt, Artificial sequence
  Synthetic sequence: Target sequence of mRNA from human reference sequence NM_130838 (human iso3); sequence of total 19mer target site + aa at ends
aaacguaaccuucaaguauguaa

SEQ ID NO: 83 - RNA, 23 nt, Artificial sequence
  Synthetic sequence: Target sequence of mRNA from human reference sequence NM_130838 (human iso3); sequence of total 19mer target site + aa at ends
aaaccacguaaccuucaaguaaa

SEQ ID NO: 84 - RNA, 23 nt, Artificial sequence
  Synthetic sequence: Target sequence of mRNA from human reference sequence NM_130838 (human iso3); sequence of total 19mer target site + aa at ends
aacaguaagcugaccuggaaaaa

SEQ ID NO: 85 - RNA, 23 nt, Artificial sequence
  Synthetic sequence: Target sequence of mRNA from human reference sequence NM_130838 (human iso3); sequence of total 19mer target site + aa at ends
aaaguagguuuacauuacugaaa

SEQ ID NO: 86 - RNA, 23 nt, Artificial sequence
  Synthetic sequence: Target sequence of mRNA from human reference sequence NM_130838 (human iso3); sequence of total 19mer target site + aa at ends
aaaaugguagucaagccuauuaa

SEQ ID NO: 87 - RNA, 23 nt, Artificial sequence
  Synthetic sequence: Target sequence of mRNA from human reference sequence NM_130838 (human iso3); sequence of total 19mer target site + aa at ends
aagccuauugcaacaaaguuaaa

SEQ ID NO: 88 - RNA, 23 nt, Artificial sequence
  Synthetic sequence: Target sequence of mRNA from human reference sequence NM_130838 (human iso3); sequence of total 19mer target site + aa at ends
aagaccacguaaccuucaaguaa

SEQ ID NO: 89 - RNA, 23 nt, Artificial sequence
  Synthetic sequence: Target sequence of mRNA from human reference sequence NM_130838 (human iso3); sequence of total 19mer target site + aa at ends
aauguuaaacguuacuuucauaa

SEQ ID NO: 90 - RNA, 23 nt, Artificial sequence
  Synthetic sequence: Target sequence of mRNA from human reference sequence NM_130838 (human iso3); sequence of total 19mer target site + aa at ends
aaauugaagcuagccgaaugaaa

SEQ ID NO: 91 - RNA, 23 nt, Artificial sequence
  Synthetic sequence: Target sequence of mRNA from human reference sequence NM_130838 (human iso3); sequence of total 19mer target site + aa at ends
aaauauaacgagggauaaauuaa

SEQ ID NO: 92 - RNA, 23 nt, Artificial sequence
  Synthetic sequence: Target sequence of mRNA from human reference sequence NM_130838 (human iso3); sequence of total 19mer target site + aa at ends
aaacuuacuuauuaccuagauaa

SEQ ID NO: 93 - RNA, 23 nt, Artificial sequence
  Synthetic sequence: Target sequence of mRNA from human reference sequence NM_130838 (human iso3); sequence of total 19mer target site + aa at ends
aauguucucguuguuguuuuaaa

SEQ ID NO: 94 - RNA, 23 nt, Artificial sequence
  Synthetic sequence: Target sequence of mRNA from human reference sequence NM_130838 (human iso3); sequence of total 19mer target site + aa at ends
aauuuuaaggguuaaaucacuaa

SEQ ID NO: 95 - RNA, 23 nt, Artificial sequence
  Synthetic sequence: Target sequence of mRNA from human reference sequence NM_130838 (human iso3); sequence of total 19mer target site + aa at ends
aaaguaacagcacaacaaauuaa

SEQ ID NO: 96 - RNA, 23 nt, Artificial sequence
  Synthetic sequence: Target sequence of mRNA from human reference sequence NM_130838 (human iso3); sequence of total 19mer target site + aa at ends
aacaacuccugcucugagauaaa

SEQ ID NO: 97 - RNA, 23 nt, Artificial sequence
  Synthetic sequence: Target sequence of mRNA from human reference sequence NM_130838 (human iso3); sequence of total 19mer target site + aa at ends
aagaugugacuuacuuaacagaa

SEQ ID NO: 98 - RNA, 23 nt, Artificial sequence
  Synthetic sequence: Target sequence of mRNA from human reference sequence NM_130838 (human iso3); sequence of total 19mer target site + aa at ends
aacauuaucguaauggagaauaa

SEQ ID NO: 99 - RNA, 23 nt, Artificial sequence
  Synthetic sequence: Target sequence of mRNA from human reference sequence NM_130838 (human iso3); sequence of total 19mer target site + aa at ends
aaccauuuuaucgaggcacguaa

SEQ ID NO: 100 - RNA, 23 nt, Artificial sequence
  Synthetic sequence: Target sequence of mRNA from human reference sequence NM_130838 (human iso3); sequence of total 19mer target site + aa at ends
aaaguagccaauccucuuucuaa

SEQ ID NO: 101 - RNA, 23 nt, Artificial sequence
  Synthetic sequence: Target sequence of mRNA from human reference sequence NM_130838 (human iso3); sequence of total 19mer target site + aa at ends
aauaauagaacgcuacuaccaaa

SEQ ID NO: 102 - RNA, 23 nt, Artificial sequence
  Synthetic sequence: Target sequence of mRNA from human reference sequence NM_130838 (human iso3); sequence of total 19mer target site + aa at ends
aacuucgugcaacuguagucaaa

SEQ ID NO: 103 - RNA, 23 nt, Artificial sequence
  Synthetic sequence: Target sequence of mRNA from human reference sequence NM_130838 (human iso3); sequence of total 19mer target site + aa at ends
aaucauauggugaccaaugaaaa

SEQ ID NO: 104 - RNA, 23 nt, Artificial sequence
  Synthetic sequence: Target sequence of mRNA from human reference sequence NM_130838 (human iso3); sequence of total 19mer target site + aa at ends
aauuaauccguguuauuggaaaa

SEQ ID NO: 105 - RNA, 23 nt, Artificial sequence
  Synthetic sequence: Target sequence of mRNA from human reference sequence NM_130838 (human iso3); sequence of total 19mer target site + aa at ends
aaauacgcuaccuugaugaaaaa

SEQ ID NO: 106 - RNA, 23 nt, Artificial sequence
  Synthetic sequence: Target sequence of mRNA from human reference sequence NM_130838 (human iso3); sequence of total 19mer target site + aa at ends
aaagcuagccgaaugaagcgaaa

SEQ ID NO: 107 - RNA, 23 nt, Artificial sequence
  Synthetic sequence: Target sequence of mRNA from human reference sequence NM_130838 (human iso3); sequence of total 19mer target site + aa at ends
aauacauacgcuaccuugaugaa

SEQ ID NO: 108 - RNA, 23 nt, Artificial sequence
  Synthetic sequence: Target sequence of mRNA from human reference sequence NM_130838 (human iso3); sequence of total 19mer target site + aa at ends
aaaauauaacgagggauaaauaa

SEQ ID NO: 109 - RNA, 23 nt, Artificial sequence
  Synthetic sequence: Target sequence of mRNA from human reference sequence NM_130838 (human iso3); sequence of total 19mer target site + aa at ends
aaguucucguuguuguuuuaaaa

SEQ ID NO: 110 - RNA, 23 nt, Artificial sequence
  Synthetic sequence: Target sequence of mRNA from human reference sequence NM_130838 (human iso3); sequence of total 19mer target site + aa at ends
aaugauugacugauuguuuuaaa

SEQ ID NO: 111 - RNA, 23 nt, Artificial sequence
  Synthetic sequence: Target sequence of mRNA from human reference sequence NM_130838 (human iso3); sequence of total 19mer target site + aa at ends
aauuuaauccguguuauuggaaa

SEQ ID NO: 112 - RNA, 23 nt, Artificial sequence
  Synthetic sequence: Target sequence of mRNA from human reference sequence NM_130838 (human iso3); sequence of total 19mer target site + aa at ends
aauguccggcuagagaugaucaa

SEQ ID NO: 113 - RNA, 23 nt, Artificial sequence
  Synthetic sequence: Target sequence of mRNA from human reference sequence NM_130838 (human iso3); sequence of total 19mer target site + aa at ends
aagcuagccgaaugaagcgagaa

SEQ ID NO: 114 - RNA, 23 nt, Artificial sequence
  Synthetic sequence: Target sequence of mRNA from human reference sequence NM_130838 (human iso3); sequence of total 19mer target site + aa at ends
aaguacauacgcuaccuugauaa

SEQ ID NO: 115 - RNA, 23 nt, Artificial sequence
  Synthetic sequence: Target sequence of mRNA from human reference sequence NM_130838 (human iso3); sequence of total 19mer target site + aa at ends
aaucgagcuuuauaagauuaaaa

SEQ ID NO: 116 - RNA, 23 nt, Artificial sequence
  Synthetic sequence: Target sequence of mRNA from human reference sequence NM_130838 (human iso3); sequence of total 19mer target site + aa at ends
aacuaccaccaguuaacugagaa

SEQ ID NO: 117 - RNA, 23 nt, Artificial sequence
  Synthetic sequence: Target sequence of mRNA from human reference sequence NM_130838 (human iso3); sequence of total 19mer target site + aa at ends
aauuuuaucgaggcacgugauaa

SEQ ID NO: 118 - RNA, 23 nt, Artificial sequence
  Synthetic sequence: Target sequence of mRNA from human reference sequence NM_130838 (human iso3); sequence of total 19mer target site + aa at ends
aaauuuuaucgaggcacgugaaa

SEQ ID NO: 119 - RNA, 23 nt, Artificial sequence
  Synthetic sequence: Target sequence of mRNA from human reference sequence NM_130838 (human iso3); sequence of total 19mer target site + aa at ends
aaaacguuacuuucauguacuaa

SEQ ID NO: 120 - RNA, 23 nt, Artificial sequence
  Synthetic sequence: Target sequence of mRNA from human reference sequence NM_130838 (human iso3); sequence of total 19mer target site + aa at ends
aaagaauucgcauguacagugaa

SEQ ID NO: 121 - RNA, 23 nt, Artificial sequence
  Synthetic sequence: Target sequence of mRNA from human reference sequence NM_130838 (human iso3); sequence of total 19mer target site + aa at ends
aaucacguaugccaaaggauuaa

SEQ ID NO: 122 - RNA, 23 nt, Artificial sequence
  Synthetic sequence: Target sequence of mRNA from human reference sequence NM_130838 (human iso3); sequence of total 19mer target site + aa at ends
aacuuuaauccguguuauuggaa

SEQ ID NO: 123 - RNA, 23 nt, Artificial sequence
  Synthetic sequence: Target sequence of mRNA from human reference sequence NM_130838 (human iso3); sequence of total 19mer target site + aa at ends
aaacauacgcuaccuugaugaaa

SEQ ID NO: 124 - RNA, 23 nt, Artificial sequence
  Synthetic sequence: Target sequence of mRNA from human reference sequence NM_130838 (human iso3); sequence of total 19mer target site + aa at ends
aauccuagucuucuguguaugaa

SEQ ID NO: 125 - RNA, 23 nt, Artificial sequence
  Synthetic sequence: Target sequence of mRNA from human reference sequence NM_130838 (human iso3); sequence of total 19mer target site + aa at ends
aacauuuuaucgaggcacgugaa

SEQ ID NO: 126 - RNA, 23 nt, Artificial sequence
  Synthetic sequence: Target sequence of mRNA from human reference sequence NM_130838 (human iso3); sequence of total 19mer target site + aa at ends
aauuaacugauuacuguagauaa

SEQ ID NO: 127 - RNA, 23 nt, Artificial sequence
  Synthetic sequence: Target sequence of mRNA from human reference sequence NM_130838 (human iso3); sequence of total 19mer target site + aa at ends
aaccuucgugcaacuguagucaa

SEQ ID NO: 128 - RNA, 23 nt, Artificial sequence
  Synthetic sequence: Target sequence of mRNA from human reference sequence NM_130838 (human iso3); sequence of total 19mer target site + aa at ends
aauguuaggguacauacgcuaaa

SEQ ID NO: 129 - RNA, 23 nt, Artificial sequence
  Synthetic sequence: Target sequence of mRNA from human reference sequence NM_130838 (human iso3); sequence of total 19mer target site + aa at ends
aacacuguuaggguacauacgaa

SEQ ID NO: 130 - RNA, 23 nt, Artificial sequence
  Synthetic sequence: Target sequence of mRNA from human reference sequence NM_130838 (human iso3); sequence of total 19mer target site + aa at ends
aauguggcacuuuucaccauaaa

SEQ ID NO: 131 - RNA, 23 nt, Artificial sequence
  Synthetic sequence: Target sequence of mRNA from human reference sequence NM_130838 (human iso3); sequence of total 19mer target site + aa at ends
aaaucacguaugccaaaggauaa

SEQ ID NO: 132 - RNA, 23 nt, Artificial sequence
  Synthetic sequence: Target sequence of mRNA from human reference sequence NM_130838 (human iso3); sequence of total 19mer target site + aa at ends
aaaggguacauacgcuaccuuaa

SEQ ID NO: 133 - RNA, 23 nt, Artificial sequence
  Synthetic sequence: Target sequence of mRNA from human reference sequence NM_130838 (human iso3); sequence of total 19mer target site + aa at ends
aaacuaaggugagacauugauaa

SEQ ID NO: 134 - RNA, 23 nt, Artificial sequence
  Synthetic sequence: Target sequence of mRNA from human reference sequence NM_130838 (human iso3); sequence of total 19mer target site + aa at ends
aaugucaccuaacguggaaugaa

SEQ ID NO: 135 - RNA, 23 nt, Artificial sequence
  Synthetic sequence: Target sequence of mRNA from human reference sequence NM_130838 (human iso3); sequence of total 19mer target site + aa at ends
aaauagaauucgcauguacagaa

SEQ ID NO: 136 - RNA, 23 nt, Artificial sequence
  Synthetic sequence: Target sequence of mRNA from human reference sequence NM_130838 (human iso3); sequence of total 19mer target site + aa at ends
aauucgugacuugggagacucaa

SEQ ID NO: 137 - RNA, 23 nt, Artificial sequence
  Synthetic sequence: Target sequence of mRNA from human reference sequence NM_130838 (human iso3); sequence of total 19mer target site + aa at ends
aauagaauucgcauguacaguaa

SEQ ID NO: 138 - RNA, 23 nt, Artificial sequence
  Synthetic sequence: Target sequence of mRNA from human reference sequence NM_130838 (human iso3); sequence of total 19mer target site + aa at ends
aaugagggcguuuuauauaauaa

SEQ ID NO: 139 - RNA, 23 nt, Artificial sequence
  Synthetic sequence: Target sequence of mRNA from human reference sequence NM_130838 (human iso3); sequence of total 19mer target site + aa at ends
aaacacuguuaggguacauacaa

SEQ ID NO: 140 - RNA, 23 nt, Artificial sequence
  Synthetic sequence: Target sequence of mRNA from human reference sequence NM_130838 (human iso3); sequence of total 19mer target site + aa at ends
aauucucguuguuguuuuaagaa

SEQ ID NO: 141 - RNA, 23 nt, Artificial sequence
  Synthetic sequence: Target sequence of mRNA from human reference sequence NM_130838 (human iso3); sequence of total 19mer target site + aa at ends
aacuguuaggguacauacgcuaa

SEQ ID NO: 142 - RNA, 23 nt, Artificial sequence
  Synthetic sequence: Target sequence of mRNA from human reference sequence NM_130838 (human iso3); sequence of total 19mer target site + aa at ends
aauuuaacuaaggugagacauaa

SEQ ID NO: 143 - RNA, 23 nt, Artificial sequence
  Synthetic sequence: Target sequence of mRNA from human reference sequence NM_130838 (human iso3); sequence of total 19mer target site + aa at ends
aauaacagucgaaaucuagugaa

SEQ ID NO: 144 - RNA, 23 nt, Artificial sequence
  Synthetic sequence: Target sequence of mRNA from human reference sequence NM_130838 (human iso3); sequence of total 19mer target site + aa at ends
aauguggucuaaauacaaugcaa

SEQ ID NO: 145 - RNA, 23 nt, Artificial sequence
  Synthetic sequence: Target sequence of mRNA from human reference sequence NM_130838 (human iso3); sequence of total 19mer target site + aa at ends
aaucaccuaacguggaaugugaa

SEQ ID NO: 146 - RNA, 23 nt, Artificial sequence
  Synthetic sequence: Target sequence of mRNA from human reference sequence NM_130838 (human iso3); sequence of total 19mer target site + aa at ends
aauucuuaguauaugaaaggaaa

SEQ ID NO: 147 - RNA, 23 nt, Artificial sequence
  Synthetic sequence: Target sequence of mRNA from human reference sequence NM_130838 (human iso3); sequence of total 19mer target site + aa at ends
aaaauagaacgcuacuaccacaa

SEQ ID NO: 148 - RNA, 23 nt, Artificial sequence
  Synthetic sequence: Target sequence of mRNA from human reference sequence NM_130838 (human iso3); sequence of total 19mer target site + aa at ends
aacugagggcguuuuauauaaaa

SEQ ID NO: 149 - RNA, 23 nt, Artificial sequence
  Synthetic sequence: Target sequence of mRNA from human reference sequence NM_130838 (human iso3); sequence of total 19mer target site + aa at ends
aaaaaucguucauucauuuacaa

SEQ ID NO: 150 - RNA, 23 nt, Artificial sequence
  Synthetic sequence: Target sequence of mRNA from human reference sequence NM_130838 (human iso3); sequence of total 19mer target site + aa at ends
aauuuucgugacuugggagacaa

SEQ ID NO: 151 - RNA, 23 nt, Artificial sequence
  Synthetic sequence: Target sequence of mRNA from human reference sequence NM_130838 (human iso3); sequence of total 19mer target site + aa at ends
aaucgugcaacuguagucaucaa

SEQ ID NO: 152 - RNA, 23 nt, Artificial sequence
  Synthetic sequence: Target sequence of mRNA from human reference sequence NM_130838 (human iso3); sequence of total 19mer target site + aa at ends
aaucauacaguaagcugaccuaa

SEQ ID NO: 153 - RNA, 23 nt, Artificial sequence
  Synthetic sequence: Target sequence of mRNA from human reference sequence NM_130838 (human iso3); sequence of total 19mer target site + aa at ends
aacgugcaacuguagucaucuaa

SEQ ID NO: 154 - RNA, 23 nt, Artificial sequence
  Synthetic sequence: Target sequence of mRNA from human reference sequence NM_130838 (human iso3); sequence of total 19mer target site + aa at ends
aaugccauuagaagggucuacaa

SEQ ID NO: 155 - RNA, 23 nt, Artificial sequence
  Synthetic sequence: Target sequence of mRNA from human reference sequence NM_130838 (human iso3); sequence of total 19mer target site + aa at ends
aauuacaauaacuguauacugaa

SEQ ID NO: 156 - RNA, 23 nt, Artificial sequence
  Synthetic sequence: Target sequence of mRNA from human reference sequence NM_130838 (human iso3); sequence of total 19mer target site + aa at ends
aauucgcauguacagugaacgaa

SEQ ID NO: 157 - DNA, 21 bp, Artificial sequence
  Synthetic sequence: dsRNA targeting E6AP. Sense strand (target sequence) having double overhang
auacgaugaaucuacaaaatt

SEQ ID NO: 158 - DNA, 21 bp, Artificial sequence
  Synthetic sequence: dsRNA targeting E6AP. Sense strand (target sequence) having double overhang
ugacuacauucucaauaaatt

SEQ ID NO: 159 - DNA, 21 bp, Artificial sequence
  Synthetic sequence: dsRNA targeting E6AP. Sense strand (target sequence) having double overhang
agccugcacgaaugaguuutt

SEQ ID NO: 160 - DNA, 21 bp, Artificial sequence
  Synthetic sequence: dsRNA targeting E6AP. Sense strand (target sequence) having double overhang
ggauugucgaaaaccacuutt

SEQ ID NO: 161 - DNA, 21 bp, Artificial sequence
  Synthetic sequence: dsRNA targeting E6AP. Sense strand (target sequence) having double overhang
cucucgagauccuaauuautt

SEQ ID NO: 162 - DNA, 21 bp, Artificial sequence
  Synthetic sequence: dsRNA targeting E6AP. Sense strand (target sequence) having double overhang
augugacuuacuuaacagatt

SEQ ID NO: 163 - DNA, 21 bp, Artificial sequence
  Synthetic sequence: dsRNA targeting E6AP. Sense strand (target sequence) having double overhang
guauacucucgagauccuatt

SEQ ID NO: 164 - DNA, 21 bp, Artificial sequence
  Synthetic sequence: dsRNA targeting E6AP. Sense strand (target sequence) having double overhang
agguuaccuacaucucauatt

SEQ ID NO: 165 - DNA, 21 bp, Artificial sequence
  Synthetic sequence: dsRNA targeting E6AP. Sense strand (target sequence) having double overhang
aguacuuauucagaccagatt

SEQ ID NO: 166 - DNA, 21 bp, Artificial sequence
  Synthetic sequence: dsRNA targeting E6AP. Sense strand (target sequence) having double overhang
auccuaauuaucugaauuutt

SEQ ID NO: 167 - DNA, 21 bp, Artificial sequence
  Synthetic sequence: dsRNA targeting E6AP. Sense strand (target sequence) having double overhang
aaggauaggugauagcucatt

SEQ ID NO: 168 - DNA, 21 bp, Artificial sequence
  Synthetic sequence: dsRNA targeting E6AP. Sense strand (target sequence) having double overhang
ggaagccggaaucuagauutt

SEQ ID NO: 169 - DNA, 21 bp, Artificial sequence
  Synthetic sequence: dsRNA targeting E6AP. Sense strand (target sequence) having double overhang
ugcuucgaagugcuugaaatt

SEQ ID NO: 170 - DNA, 21 bp, Artificial sequence
  Synthetic sequence: dsRNA targeting E6AP. Sense strand (target sequence) having double overhang
uggauugucgaaaaccacutt

SEQ ID NO: 171 - DNA, 21 bp, Artificial sequence
  Synthetic sequence: dsRNA targeting E6AP. Sense strand (target sequence) having double overhang
cggcuagagaugaucgcuatt

SEQ ID NO: 172 - DNA, 21 bp, Artificial sequence
  Synthetic sequence: dsRNA targeting E6AP. Sense strand (target sequence) having double overhang
acagucgaaaucuagugaatt

SEQ ID NO: 173 - DNA, 21 bp, Artificial sequence
  Synthetic sequence: dsRNA targeting E6AP. Sense strand (target sequence) having double overhang
gaucagacuguggucuaaatt

SEQ ID NO: 174 - DNA, 21 bp, Artificial sequence
  Synthetic sequence: dsRNA targeting E6AP. Sense strand (target sequence) having double overhang
cucgagauccuaauuaucutt

SEQ ID NO: 175 - DNA, 21 bp, Artificial sequence
  Synthetic sequence: dsRNA targeting E6AP. Sense strand (target sequence) having double overhang
uaucguaauggagaauagatt

SEQ ID NO: 176 - DNA, 21 bp, Artificial sequence
  Synthetic sequence: dsRNA targeting E6AP. Sense strand (target sequence) having double overhang
cucaaaguuagacgugacctt

SEQ ID NO: 177 - DNA, 21 bp, Artificial sequence
  Synthetic sequence: dsRNA targeting E6AP. Sense strand (target sequence) having double overhang
aggauaggugauagcucactt

SEQ ID NO: 178 - DNA, 21 bp, Artificial sequence
  Synthetic sequence: dsRNA targeting E6AP. Sense strand (target sequence) having double overhang
caccuaacguggaaugugatt

SEQ ID NO: 179 - DNA, 21 bp, Artificial sequence
  Synthetic sequence: dsRNA targeting E6AP. Sense strand (target sequence) having double overhang
aaucguucauucauuuacatt

SEQ ID NO: 180 - DNA, 21 bp, Artificial sequence
  Synthetic sequence: dsRNA targeting E6AP. Sense strand (target sequence) having double overhang
cuugacguaucacaauguatt

SEQ ID NO: 181 - DNA, 21 bp, Artificial sequence
  Synthetic sequence: dsRNA targeting E6AP. Sense strand (target sequence) having double overhang
ugguauguucacauacgautt

SEQ ID NO: 182 - DNA, 21 bp, Artificial sequence
  Synthetic sequence: dsRNA targeting E6AP. Sense strand (target sequence) having double overhang
gauaggugauagcucacagtt

SEQ ID NO: 183 - DNA, 21 bp, Artificial sequence
  Synthetic sequence: dsRNA targeting E6AP. Sense strand (target sequence) having double overhang
ccggcuagagaugaucgcutt

SEQ ID NO: 184 - DNA, 21 bp, Artificial sequence
  Synthetic sequence: dsRNA targeting E6AP. Sense strand (target sequence) having double overhang
cauaguacugggucuggcutt

SEQ ID NO: 185 - DNA, 21 bp, Artificial sequence
  Synthetic sequence: dsRNA targeting E6AP. Sense strand (target sequence) having double overhang
aauguauacucucgagauctt

SEQ ID NO: 186 - DNA, 21 bp, Artificial sequence
  Synthetic sequence: dsRNA targeting E6AP. Sense strand (target sequence) having double overhang
aacuuuucgugacuugggatt

SEQ ID NO: 187 - DNA, 21 bp, Artificial sequence
  Synthetic sequence: dsRNA targeting E6AP. Sense strand (target sequence) having double overhang
aaaguuagacgugaccauatt

SEQ ID NO: 188 - DNA, 21 bp, Artificial sequence
  Synthetic sequence: dsRNA targeting E6AP. Sense strand (target sequence) having double overhang
ugauuagggaguucugggatt

SEQ ID NO: 189 - DNA, 21 bp, Artificial sequence
  Synthetic sequence: dsRNA targeting E6AP. Sense strand (target sequence) having double overhang
uacgaugaaucuacaaaautt

SEQ ID NO: 190 - DNA, 21 bp, Artificial sequence
  Synthetic sequence: dsRNA targeting E6AP. Sense strand (target sequence) having double overhang
cuuguccggcuagagaugatt

SEQ ID NO: 191 - DNA, 21 bp, Artificial sequence
  Synthetic sequence: dsRNA targeting E6AP. Sense strand (target sequence) having double overhang
uauacucucgagauccuaatt

SEQ ID NO: 192 - DNA, 21 bp, Artificial sequence
  Synthetic sequence: dsRNA targeting E6AP. Sense strand (target sequence) having double overhang
acuugacguaucacaaugutt

SEQ ID NO: 193 - DNA, 21 bp, Artificial sequence
  Synthetic sequence: dsRNA targeting E6AP. Sense strand (target sequence) having double overhang
aacagucgaaaucuagugatt

SEQ ID NO: 194 - DNA, 21 bp, Artificial sequence
  Synthetic sequence: dsRNA targeting E6AP. Sense strand (target sequence) having double overhang
ucauuaucguaauggagaatt

SEQ ID NO: 195 - DNA, 21 bp, Artificial sequence
  Synthetic sequence: dsRNA targeting E6AP. Sense strand (target sequence) having double overhang
auaguacugggucuggcuatt

SEQ ID NO: 196 - DNA, 21 bp, Artificial sequence
  Synthetic sequence: dsRNA targeting E6AP. Sense strand (target sequence) having double overhang
ccuaacguggaaugugacutt

SEQ ID NO: 197 - DNA, 21 bp, Artificial sequence
  Synthetic sequence: dsRNA targeting E6AP. Sense strand (target sequence) having double overhang
uuguccggcuagagaugautt

SEQ ID NO: 198 - DNA, 21 bp, Artificial sequence
  Synthetic sequence: dsRNA targeting E6AP. Sense strand (target sequence) having double overhang
accuaacguggaaugugactt

SEQ ID NO: 199 - DNA, 21 bp, Artificial sequence
  Synthetic sequence: dsRNA targeting E6AP. Sense strand (target sequence) having double overhang
uuaacagucgaaaucuagutt

SEQ ID NO: 200 - DNA, 21 bp, Artificial sequence
  Synthetic sequence: dsRNA targeting E6AP. Sense strand (target sequence) having double overhang
uuggcauaguacugggucutt

SEQ ID NO: 201 - DNA, 21 bp, Artificial sequence
  Synthetic sequence: dsRNA targeting E6AP. Sense strand (target sequence) having double overhang
gaacuuuucgugacuugggtt

SEQ ID NO: 202 - DNA, 21 bp, Artificial sequence
  Synthetic sequence: dsRNA targeting E6AP. Sense strand (target sequence) having double overhang
guccggcuagagaugaucgtt

SEQ ID NO: 203 - DNA, 21 bp, Artificial sequence
  Synthetic sequence: dsRNA targeting E6AP. Sense strand (target sequence) having double overhang
gcccucgagcuuuauaagatt

SEQ ID NO: 204 - DNA, 21 bp, Artificial sequence
  Synthetic sequence: dsRNA targeting E6AP. Sense strand (target sequence) having double overhang
cucgagcuuuauaagauuatt

SEQ ID NO: 205 - DNA, 21 bp, Artificial sequence
  Synthetic sequence: dsRNA targeting E6AP. Sense strand (target sequence) having double overhang
uggcauaguacugggucugtt

SEQ ID NO: 206 - DNA, 21 bp, Artificial sequence
  Synthetic sequence: dsRNA targeting E6AP. Sense strand (target sequence) having double overhang
acgaaugaguuuugugcuutt

SEQ ID NO: 207 - DNA, 21 bp, Artificial sequence
  Synthetic sequence: dsRNA targeting E6AP. Sense strand (target sequence) having double overhang
uuucuucguauggauaauatt

SEQ ID NO: 208 - DNA, 21 bp, Artificial sequence
  Synthetic sequence: dsRNA targeting E6AP. Sense strand (target sequence) having double overhang
agacgugaccauaucauagtt

SEQ ID NO: 209 - DNA, 21 bp, Artificial sequence
  Synthetic sequence: dsRNA targeting E6AP. Sense strand (target sequence) having double overhang
uaguacugggucuggcuautt

SEQ ID NO: 210 - DNA, 21 bp, Artificial sequence
  Synthetic sequence: dsRNA targeting E6AP. Sense strand (target sequence) having double overhang
cguauggauaauaaugcagtt

SEQ ID NO: 211 - DNA, 21 bp, Artificial sequence
  Synthetic sequence: dsRNA targeting E6AP. Sense strand (target sequence) having double overhang
uggcuauuuacaauaacugtt

SEQ ID NO: 212 - DNA, 21 bp, Artificial sequence
  Synthetic sequence: dsRNA targeting E6AP. Sense strand (target sequence) having double overhang
aauucgcauguacagugaatt

SEQ ID NO: 213 - DNA, 21 bp, Artificial sequence
  Synthetic sequence: dsRNA targeting E6AP. Sense strand (target sequence) having double overhang
aauagaauucgcauguacatt

SEQ ID NO: 214 - DNA, 21 bp, Artificial sequence
  Synthetic sequence: dsRNA targeting E6AP. Sense strand (target sequence) having double overhang
ugguaacccaaugauguautt

SEQ ID NO: 215 - DNA, 21 bp, Artificial sequence
  Synthetic sequence: dsRNA targeting E6AP. Sense strand (target sequence) having double overhang
agccggaaucuagauuucctt

SEQ ID NO: 216 - DNA, 21 bp, Artificial sequence
  Synthetic sequence: dsRNA targeting E6AP. Sense strand (target sequence) having double overhang
acuuuucgugacuugggagtt

SEQ ID NO: 217 - DNA, 21 bp, Artificial sequence
  Synthetic sequence: dsRNA targeting E6AP. Sense strand (target sequence) having double overhang
agcccucgagcuuuauaagtt

SEQ ID NO: 218 - DNA, 21 bp, Artificial sequence
  Synthetic sequence: dsRNA targeting E6AP. Sense strand (target sequence) having double overhang
gaacgaagaaucacuguuctt

SEQ ID NO: 219 - DNA, 21 bp, Artificial sequence
  Synthetic sequence: dsRNA targeting E6AP. Sense strand (target sequence) having double overhang
uauucugacuacauucucatt

SEQ ID NO: 220 - DNA, 21 bp, Artificial sequence
  Synthetic sequence: dsRNA targeting E6AP. Sense strand (target sequence) having double overhang
gcaucuaauagaacgcuactt

SEQ ID NO: 221 - DNA, 21 bp, Artificial sequence
  Synthetic sequence: dsRNA targeting E6AP. Sense strand (target sequence) having double overhang
ucgaaaucuagugaaugautt

SEQ ID NO: 222 - DNA, 21 bp, Artificial sequence
  Synthetic sequence: dsRNA targeting E6AP. Sense strand (target sequence) having double overhang
agucgaaaucuagugaaugtt

SEQ ID NO: 223 - DNA, 21 bp, Artificial sequence
  Synthetic sequence: dsRNA targeting E6AP. Sense strand (target sequence) having double overhang
gaaaggcgcuagaauugautt

SEQ ID NO: 224 - DNA, 21 bp, Artificial sequence
  Synthetic sequence: dsRNA targeting E6AP. Sense strand (target sequence) having double overhang
aaaggcgcuagaauugauutt

SEQ ID NO: 225 - DNA, 21 bp, Artificial sequence
  Synthetic sequence: dsRNA targeting E6AP. Sense strand (target sequence) having double overhang
aggcgcuagaauugauuuutt

SEQ ID NO: 226 - DNA, 21 bp, Artificial sequence
  Synthetic sequence: dsRNA targeting E6AP. Sense strand (target sequence) having double overhang
agcaucuaauagaacgcuatt

SEQ ID NO: 227 - DNA, 21 bp, Artificial sequence
  Synthetic sequence: dsRNA targeting E6AP. Sense strand (target sequence) having double overhang
caaagcgaugagcaagcuatt

SEQ ID NO: 228 - DNA, 21 bp, Artificial sequence
  Synthetic sequence: dsRNA targeting E6AP. Sense strand (target sequence) having double overhang
ccaugguugucuacaggaatt

SEQ ID NO: 229 - DNA, 21 bp, Artificial sequence
  Synthetic sequence: dsRNA targeting E6AP. Sense strand (target sequence) having double overhang
agaaaggcgcuagaauugatt

SEQ ID NO: 230 - DNA, 21 bp, Artificial sequence
  Synthetic sequence: dsRNA targeting E6AP. Sense strand (target sequence) having double overhang
aacgcuacuaccaccaguutt

SEQ ID NO: 231 - DNA, 21 bp, Artificial sequence
  Synthetic sequence: dsRNA targeting E6AP. Sense strand (target sequence) having double overhang
gcgcuagaauugauuuuaatt

SEQ ID NO: 232 - DNA, 21 bp, Artificial sequence
  Synthetic sequence: dsRNA targeting E6AP. Sense strand (target sequence) having double overhang
gcacgugaucaguguugcatt

SEQ ID NO: 233 - DNA, 21 bp, Artificial sequence
  Synthetic sequence: dsRNA targeting E6AP. Sense strand (target sequence) having double overhang
gauagugucccaguacaaatt

SEQ ID NO: 234 - DNA, 21 bp, Artificial sequence
  Synthetic sequence: dsRNA targeting E6AP. Sense strand (target sequence) having double overhang
uuugcgugaaaguguuacatt

SEQ ID NO: 235 - DNA, 21 bp, Artificial sequence
  Synthetic sequence: dsRNA targeting E6AP. Sense strand (target sequence) having double overhang
aguaugugcuacuuuuuugtt

SEQ ID NO: 236 - DNA, 21 bp, Artificial sequence
  Synthetic sequence: dsRNA targeting E6AP. Sense strand (target sequence) having double overhang
guaugucgucuucaugugutt

SEQ ID NO: 237 - DNA, 21 bp, Artificial sequence
  Synthetic sequence: dsRNA targeting E6AP. Sense strand (target sequence) having double overhang
gguagucaagccuauugcatt

SEQ ID NO: 238 - DNA, 21 bp, Artificial sequence
  Synthetic sequence: dsRNA targeting E6AP. Sense strand (target sequence) having double overhang
acguaaccuucaaguaugutt

SEQ ID NO: 239 - DNA, 21 bp, Artificial sequence
  Synthetic sequence: dsRNA targeting E6AP. Sense strand (target sequence) having double overhang
accacguaaccuucaaguatt

SEQ ID NO: 240 - DNA, 21 bp, Artificial sequence
  Synthetic sequence: dsRNA targeting E6AP. Sense strand (target sequence) having double overhang
caguaagcugaccuggaaatt

SEQ ID NO: 241 - DNA, 21 bp, Artificial sequence
  Synthetic sequence: dsRNA targeting E6AP. Sense strand (target sequence) having double overhang
aguagguuuacauuacugatt

SEQ ID NO: 242 - DNA, 21 bp, Artificial sequence
  Synthetic sequence: dsRNA targeting E6AP. Sense strand (target sequence) having double overhang
aaugguagucaagccuauutt

SEQ ID NO: 243 - DNA, 21 bp, Artificial sequence
  Synthetic sequence: dsRNA targeting E6AP. Sense strand (target sequence) having double overhang
gccuauugcaacaaaguuatt

SEQ ID NO: 244 - DNA, 21 bp, Artificial sequence
  Synthetic sequence: dsRNA targeting E6AP. Sense strand (target sequence) having double overhang
gaccacguaaccuucaagutt

SEQ ID NO: 245 - DNA, 21 bp, Artificial sequence
  Synthetic sequence: dsRNA targeting E6AP. Sense strand (target sequence) having double overhang
uguuaaacguuacuuucautt

SEQ ID NO: 246 - DNA, 21 bp, Artificial sequence
  Synthetic sequence: dsRNA targeting E6AP. Sense strand (target sequence) having double overhang
auugaagcuagccgaaugatt

SEQ ID NO: 247 - DNA, 21 bp, Artificial sequence
  Synthetic sequence: dsRNA targeting E6AP. Sense strand (target sequence) having double overhang
auauaacgagggauaaauutt

SEQ ID NO: 248 - DNA, 21 bp, Artificial sequence
  Synthetic sequence: dsRNA targeting E6AP. Sense strand (target sequence) having double overhang
acuuacuuauuaccuagautt

SEQ ID NO: 249 - DNA, 21 bp, Artificial sequence
  Synthetic sequence: dsRNA targeting E6AP. Sense strand (target sequence) having double overhang
uguucucguuguuguuuuatt

SEQ ID NO: 250 - DNA, 21 bp, Artificial sequence
  Synthetic sequence: dsRNA targeting E6AP. Sense strand (target sequence) having double overhang
uuuuaaggguuaaaucacutt

SEQ ID NO: 251 - DNA, 21 bp, Artificial sequence
  Synthetic sequence: dsRNA targeting E6AP. Sense strand (target sequence) having double overhang
aguaacagcacaacaaauutt

SEQ ID NO: 252 - DNA, 21 bp, Artificial sequence
  Synthetic sequence: dsRNA targeting E6AP. Sense strand (target sequence) having double overhang
caacuccugcucugagauatt

SEQ ID NO: 253 - DNA, 21 bp, Artificial sequence
  Synthetic sequence: dsRNA targeting E6AP. Sense strand (target sequence) having double overhang
gaugugacuuacuuaacagtt

SEQ ID NO: 254 - DNA, 21 bp, Artificial sequence
  Synthetic sequence: dsRNA targeting E6AP. Sense strand (target sequence) having double overhang
cauuaucguaauggagaautt

SEQ ID NO: 255 - DNA, 21 bp, Artificial sequence
  Synthetic sequence: dsRNA targeting E6AP. Sense strand (target sequence) having double overhang
ccauuuuaucgaggcacgutt

SEQ ID NO: 256 - DNA, 21 bp, Artificial sequence
  Synthetic sequence: dsRNA targeting E6AP. Sense strand (target sequence) having double overhang
aguagccaauccucuuucutt

SEQ ID NO: 257 - DNA, 21 bp, Artificial sequence
  Synthetic sequence: dsRNA targeting E6AP. Sense strand (target sequence) having double overhang
uaauagaacgcuacuaccatt

SEQ ID NO: 258 - DNA, 21 bp, Artificial sequence
  Synthetic sequence: dsRNA targeting E6AP. Sense strand (target sequence) having double overhang
cuucgugcaacuguagucatt

SEQ ID NO: 259 - DNA, 21 bp, Artificial sequence
  Synthetic sequence: dsRNA targeting E6AP. Sense strand (target sequence) having double overhang
ucauauggugaccaaugaatt

SEQ ID NO: 260 - DNA, 21 bp, Artificial sequence
  Synthetic sequence: dsRNA targeting E6AP. Sense strand (target sequence) having double overhang
uuaauccguguuauuggaatt

SEQ ID NO: 261 - DNA, 21 bp, Artificial sequence
  Synthetic sequence: dsRNA targeting E6AP. Sense strand (target sequence) having double overhang
auacgcuaccuugaugaaatt

SEQ ID NO: 262 - DNA, 21 bp, Artificial sequence
  Synthetic sequence: dsRNA targeting E6AP. Sense strand (target sequence) having double overhang
agcuagccgaaugaagcgatt

SEQ ID NO: 263 - DNA, 21 bp, Artificial sequence
  Synthetic sequence: dsRNA targeting E6AP. Sense strand (target sequence) having double overhang
uacauacgcuaccuugaugtt

SEQ ID NO: 264 - DNA, 21 bp, Artificial sequence
  Synthetic sequence: dsRNA targeting E6AP. Sense strand (target sequence) having double overhang
aauauaacgagggauaaautt

SEQ ID NO: 265 - DNA, 21 bp, Artificial sequence
  Synthetic sequence: dsRNA targeting E6AP. Sense strand (target sequence) having double overhang
guucucguuguuguuuuaatt

SEQ ID NO: 266 - DNA, 21 bp, Artificial sequence
  Synthetic sequence: dsRNA targeting E6AP. Sense strand (target sequence) having double overhang
ugauugacugauuguuuuatt

SEQ ID NO: 267 - DNA, 21 bp, Artificial sequence
  Synthetic sequence: dsRNA targeting E6AP. Sense strand (target sequence) having double overhang
uuuaauccguguuauuggatt

SEQ ID NO: 268 - DNA, 21 bp, Artificial sequence
  Synthetic sequence: dsRNA targeting E6AP. Sense strand (target sequence) having double overhang
uguccggcuagagaugauctt

SEQ ID NO: 269 - DNA, 21 bp, Artificial sequence
  Synthetic sequence: dsRNA targeting E6AP. Sense strand (target sequence) having double overhang
gcuagccgaaugaagcgagtt

SEQ ID NO: 270 - DNA, 21 bp, Artificial sequence
  Synthetic sequence: dsRNA targeting E6AP. Sense strand (target sequence) having double overhang
guacauacgcuaccuugautt

SEQ ID NO: 271 - DNA, 21 bp, Artificial sequence
  Synthetic sequence: dsRNA targeting E6AP. Sense strand (target sequence) having double overhang
ucgagcuuuauaagauuaatt

SEQ ID NO: 272 - DNA, 21 bp, Artificial sequence
  Synthetic sequence: dsRNA targeting E6AP. Sense strand (target sequence) having double overhang
cuaccaccaguuaacugagtt

SEQ ID NO: 273 - DNA, 21 bp, Artificial sequence
  Synthetic sequence: dsRNA targeting E6AP. Sense strand (target sequence) having double overhang
uuuuaucgaggcacgugautt

SEQ ID NO: 274 - DNA, 21 bp, Artificial sequence
  Synthetic sequence: dsRNA targeting E6AP. Sense strand (target sequence) having double overhang
auuuuaucgaggcacgugatt

SEQ ID NO: 275 - DNA, 21 bp, Artificial sequence
  Synthetic sequence: dsRNA targeting E6AP. Sense strand (target sequence) having double overhang
aacguuacuuucauguacutt

SEQ ID NO: 276 - DNA, 21 bp, Artificial sequence
  Synthetic sequence: dsRNA targeting E6AP. Sense strand (target sequence) having double overhang
agaauucgcauguacagugtt

SEQ ID NO: 277 - DNA, 21 bp, Artificial sequence
  Synthetic sequence: dsRNA targeting E6AP. Sense strand (target sequence) having double overhang
ucacguaugccaaaggauutt

SEQ ID NO: 278 - DNA, 21 bp, Artificial sequence
  Synthetic sequence: dsRNA targeting E6AP. Sense strand (target sequence) having double overhang
cuuuaauccguguuauuggtt

SEQ ID NO: 279 - DNA, 21 bp, Artificial sequence
  Synthetic sequence: dsRNA targeting E6AP. Sense strand (target sequence) having double overhang
acauacgcuaccuugaugatt

SEQ ID NO: 280 - DNA, 21 bp, Artificial sequence
  Synthetic sequence: dsRNA targeting E6AP. Sense strand (target sequence) having double overhang
uccuagucuucuguguaugtt

SEQ ID NO: 281 - DNA, 21 bp, Artificial sequence
  Synthetic sequence: dsRNA targeting E6AP. Sense strand (target sequence) having double overhang
cauuuuaucgaggcacgugtt

SEQ ID NO: 282 - DNA, 21 bp, Artificial sequence
  Synthetic sequence: dsRNA targeting E6AP. Sense strand (target sequence) having double overhang
uuaacugauuacuguagautt

SEQ ID NO: 283 - DNA, 21 bp, Artificial sequence
  Synthetic sequence: dsRNA targeting E6AP. Sense strand (target sequence) having double overhang
ccuucgugcaacuguaguctt

SEQ ID NO: 284 - DNA, 21 bp, Artificial sequence
  Synthetic sequence: dsRNA targeting E6AP. Sense strand (target sequence) having double overhang
uguuaggguacauacgcuatt

SEQ ID NO: 285 - DNA, 21 bp, Artificial sequence
  Synthetic sequence: dsRNA targeting E6AP. Sense strand (target sequence) having double overhang
cacuguuaggguacauacgtt

SEQ ID NO: 286 - DNA, 21 bp, Artificial sequence
  Synthetic sequence: dsRNA targeting E6AP. Sense strand (target sequence) having double overhang
uguggcacuuuucaccauatt

SEQ ID NO: 287 - DNA, 21 bp, Artificial sequence
  Synthetic sequence: dsRNA targeting E6AP. Sense strand (target sequence) having double overhang
aucacguaugccaaaggautt

SEQ ID NO: 288 - DNA, 21 bp, Artificial sequence
  Synthetic sequence: dsRNA targeting E6AP. Sense strand (target sequence) having double overhang
aggguacauacgcuaccuutt

SEQ ID NO: 289 - DNA, 21 bp, Artificial sequence
  Synthetic sequence: dsRNA targeting E6AP. Sense strand (target sequence) having double overhang
acuaaggugagacauugautt

SEQ ID NO: 290 - DNA, 21 bp, Artificial sequence
  Synthetic sequence: dsRNA targeting E6AP. Sense strand (target sequence) having double overhang
ugucaccuaacguggaaugtt

SEQ ID NO: 291 - DNA, 21 bp, Artificial sequence
  Synthetic sequence: dsRNA targeting E6AP. Sense strand (target sequence) having double overhang
auagaauucgcauguacagtt

SEQ ID NO: 292 - DNA, 21 bp, Artificial sequence
  Synthetic sequence: dsRNA targeting E6AP. Sense strand (target sequence) having double overhang
uucgugacuugggagacuctt

SEQ ID NO: 293 - DNA, 21 bp, Artificial sequence
  Synthetic sequence: dsRNA targeting E6AP. Sense strand (target sequence) having double overhang
uagaauucgcauguacagutt

SEQ ID NO: 294 - DNA, 21 bp, Artificial sequence
  Synthetic sequence: dsRNA targeting E6AP. Sense strand (target sequence) having double overhang
ugagggcguuuuauauaautt

SEQ ID NO: 295 - DNA, 21 bp, Artificial sequence
  Synthetic sequence: dsRNA targeting E6AP. Sense strand (target sequence) having double overhang
acacuguuaggguacauactt

SEQ ID NO: 296 - DNA, 21 bp, Artificial sequence
  Synthetic sequence: dsRNA targeting E6AP. Sense strand (target sequence) having double overhang
uucucguuguuguuuuaagtt

SEQ ID NO: 297 - DNA, 21 bp, Artificial sequence
  Synthetic sequence: dsRNA targeting E6AP. Sense strand (target sequence) having double overhang
cuguuaggguacauacgcutt

SEQ ID NO: 298 - DNA, 21 bp, Artificial sequence
  Synthetic sequence: dsRNA targeting E6AP. Sense strand (target sequence) having double overhang
uuuaacuaaggugagacautt

SEQ ID NO: 299 - DNA, 21 bp, Artificial sequence
  Synthetic sequence: dsRNA targeting E6AP. Sense strand (target sequence) having double overhang
uaacagucgaaaucuagugtt

SEQ ID NO: 300 - DNA, 21 bp, Artificial sequence
  Synthetic sequence: dsRNA targeting E6AP. Sense strand (target sequence) having double overhang
uguggucuaaauacaaugctt

SEQ ID NO: 301 - DNA, 21 bp, Artificial sequence
  Synthetic sequence: dsRNA targeting E6AP. Sense strand (target sequence) having double overhang
ucaccuaacguggaaugugtt

SEQ ID NO: 302 - DNA, 21 bp, Artificial sequence
  Synthetic sequence: dsRNA targeting E6AP. Sense strand (target sequence) having double overhang
uucuuaguauaugaaaggatt

SEQ ID NO: 303 - DNA, 21 bp, Artificial sequence
  Synthetic sequence: dsRNA targeting E6AP. Sense strand (target sequence) having double overhang
aauagaacgcuacuaccactt

SEQ ID NO: 304 - DNA, 21 bp, Artificial sequence
  Synthetic sequence: dsRNA targeting E6AP. Sense strand (target sequence) having double overhang
cugagggcguuuuauauaatt

SEQ ID NO: 305 - DNA, 21 bp, Artificial sequence
  Synthetic sequence: dsRNA targeting E6AP. Sense strand (target sequence) having double overhang
aaaucguucauucauuuactt

SEQ ID NO: 306 - DNA, 21 bp, Artificial sequence
  Synthetic sequence: dsRNA targeting E6AP. Sense strand (target sequence) having double overhang
uuuucgugacuugggagactt

SEQ ID NO: 307 - DNA, 21 bp, Artificial sequence
  Synthetic sequence: dsRNA targeting E6AP. Sense strand (target sequence) having double overhang
ucgugcaacuguagucauctt

SEQ ID NO: 308 - DNA, 21 bp, Artificial sequence
  Synthetic sequence: dsRNA targeting E6AP. Sense strand (target sequence) having double overhang
ucauacaguaagcugaccutt

SEQ ID NO: 309 - DNA, 21 bp, Artificial sequence
  Synthetic sequence: dsRNA targeting E6AP. Sense strand (target sequence) having double overhang
cgugcaacuguagucaucutt

SEQ ID NO: 310 - DNA, 21 bp, Artificial sequence
  Synthetic sequence: dsRNA targeting E6AP. Sense strand (target sequence) having double overhang
ugccauuagaagggucuactt

SEQ ID NO: 311 - DNA, 21 bp, Artificial sequence
  Synthetic sequence: dsRNA targeting E6AP. Sense strand (target sequence) having double overhang
uuacaauaacuguauacugtt

SEQ ID NO: 312 - DNA, 21 bp, Artificial sequence
  Synthetic sequence: dsRNA targeting E6AP. Sense strand (target sequence) having double overhang
uucgcauguacagugaacgtt

SEQ ID NO: 313 - DNA, 21 bp, Artificial sequence
  Synthetic sequence: dsRNA targeting E6AP. Antisense strand (guide sequence) having double overhang
uuuuguagauucaucguautt

SEQ ID NO: 314 - DNA, 21 bp, Artificial sequence
  Synthetic sequence: dsRNA targeting E6AP. Antisense strand (guide sequence) having double overhang
uuuauugagaauguagucatt

SEQ ID NO: 315 - DNA, 21 bp, Artificial sequence
  Synthetic sequence: dsRNA targeting E6AP. Antisense strand (guide sequence) having double overhang
aaacucauucgugcaggcutt

SEQ ID NO: 316 - DNA, 21 bp, Artificial sequence
  Synthetic sequence: dsRNA targeting E6AP. Antisense strand (guide sequence) having double overhang
aagugguuuucgacaaucctt

SEQ ID NO: 317 - DNA, 21 bp, Artificial sequence
  Synthetic sequence: dsRNA targeting E6AP. Antisense strand (guide sequence) having double overhang
auaauuaggaucucgagagtt

SEQ ID NO: 318 - DNA, 21 bp, Artificial sequence
  Synthetic sequence: dsRNA targeting E6AP. Antisense strand (guide sequence) having double overhang
ucuguuaaguaagucacautt

SEQ ID NO: 319 - DNA, 21 bp, Artificial sequence
  Synthetic sequence: dsRNA targeting E6AP. Antisense strand (guide sequence) having double overhang
uaggaucucgagaguauactt

SEQ ID NO: 320 - DNA, 21 bp, Artificial sequence
  Synthetic sequence: dsRNA targeting E6AP. Antisense strand (guide sequence) having double overhang
uaugagauguagguaaccutt

SEQ ID NO: 321 - DNA, 21 bp, Artificial sequence
  Synthetic sequence: dsRNA targeting E6AP. Antisense strand (guide sequence) having double overhang
ucuggucugaauaaguacutt

SEQ ID NO: 322 - DNA, 21 bp, Artificial sequence
  Synthetic sequence: dsRNA targeting E6AP. Antisense strand (guide sequence) having double overhang
aaauucagauaauuaggautt

SEQ ID NO: 323 - DNA, 21 bp, Artificial sequence
  Synthetic sequence: dsRNA targeting E6AP. Antisense strand (guide sequence) having double overhang
ugagcuaucaccuauccuutt

SEQ ID NO: 324 - DNA, 21 bp, Artificial sequence
  Synthetic sequence: dsRNA targeting E6AP. Antisense strand (guide sequence) having double overhang
aaucuagauuccggcuucctt

SEQ ID NO: 325 - DNA, 21 bp, Artificial sequence
  Synthetic sequence: dsRNA targeting E6AP. Antisense strand (guide sequence) having double overhang
uuucaagcacuucgaagcatt

SEQ ID NO: 326 - DNA, 21 bp, Artificial sequence
  Synthetic sequence: dsRNA targeting E6AP. Antisense strand (guide sequence) having double overhang
agugguuuucgacaauccatt

SEQ ID NO: 327 - DNA, 21 bp, Artificial sequence
  Synthetic sequence: dsRNA targeting E6AP. Antisense strand (guide sequence) having double overhang
uagcgaucaucucuagccgtt

SEQ ID NO: 328 - DNA, 21 bp, Artificial sequence
  Synthetic sequence: dsRNA targeting E6AP. Antisense strand (guide sequence) having double overhang
uucacuagauuucgacugutt

SEQ ID NO: 329 - DNA, 21 bp, Artificial sequence
  Synthetic sequence: dsRNA targeting E6AP. Antisense strand (guide sequence) having double overhang
uuuagaccacagucugauctt

SEQ ID NO: 330 - DNA, 21 bp, Artificial sequence
  Synthetic sequence: dsRNA targeting E6AP. Antisense strand (guide sequence) having double overhang
agauaauuaggaucucgagtt

SEQ ID NO: 331 - DNA, 21 bp, Artificial sequence
  Synthetic sequence: dsRNA targeting E6AP. Antisense strand (guide sequence) having double overhang
ucuauucuccauuacgauatt

SEQ ID NO: 332 - DNA, 21 bp, Artificial sequence
  Synthetic sequence: dsRNA targeting E6AP. Antisense strand (guide sequence) having double overhang
ggucacgucuaacuuugagtt

SEQ ID NO: 333 - DNA, 21 bp, Artificial sequence
  Synthetic sequence: dsRNA targeting E6AP. Antisense strand (guide sequence) having double overhang
gugagcuaucaccuauccutt

SEQ ID NO: 334 - DNA, 21 bp, Artificial sequence
  Synthetic sequence: dsRNA targeting E6AP. Antisense strand (guide sequence) having double overhang
ucacauuccacguuaggugtt

SEQ ID NO: 335 - DNA, 21 bp, Artificial sequence
  Synthetic sequence: dsRNA targeting E6AP. Antisense strand (guide sequence) having double overhang
uguaaaugaaugaacgauutt

SEQ ID NO: 336 - DNA, 21 bp, Artificial sequence
  Synthetic sequence: dsRNA targeting E6AP. Antisense strand (guide sequence) having double overhang
uacauugugauacgucaagtt

SEQ ID NO: 337 - DNA, 21 bp, Artificial sequence
  Synthetic sequence: dsRNA targeting E6AP. Antisense strand (guide sequence) having double overhang
aucguaugugaacauaccatt

SEQ ID NO: 338 - DNA, 21 bp, Artificial sequence
  Synthetic sequence: dsRNA targeting E6AP. Antisense strand (guide sequence) having double overhang
cugugagcuaucaccuauctt

SEQ ID NO: 339 - DNA, 21 bp, Artificial sequence
  Synthetic sequence: dsRNA targeting E6AP. Antisense strand (guide sequence) having double overhang
agcgaucaucucuagccggtt

SEQ ID NO: 340 - DNA, 21 bp, Artificial sequence
  Synthetic sequence: dsRNA targeting E6AP. Antisense strand (guide sequence) having double overhang
agccagacccaguacuaugtt

SEQ ID NO: 341 - DNA, 21 bp, Artificial sequence
  Synthetic sequence: dsRNA targeting E6AP. Antisense strand (guide sequence) having double overhang
gaucucgagaguauacauutt

SEQ ID NO: 342 - DNA, 21 bp, Artificial sequence
  Synthetic sequence: dsRNA targeting E6AP. Antisense strand (guide sequence) having double overhang
ucccaagucacgaaaaguutt

SEQ ID NO: 343 - DNA, 21 bp, Artificial sequence
  Synthetic sequence: dsRNA targeting E6AP. Antisense strand (guide sequence) having double overhang
uauggucacgucuaacuuutt

SEQ ID NO: 344 - DNA, 21 bp, Artificial sequence
  Synthetic sequence: dsRNA targeting E6AP. Antisense strand (guide sequence) having double overhang
ucccagaacucccuaaucatt

SEQ ID NO: 345 - DNA, 21 bp, Artificial sequence
  Synthetic sequence: dsRNA targeting E6AP. Antisense strand (guide sequence) having double overhang
auuuuguagauucaucguatt

SEQ ID NO: 346 - DNA, 21 bp, Artificial sequence
  Synthetic sequence: dsRNA targeting E6AP. Antisense strand (guide sequence) having double overhang
ucaucucuagccggacaagtt

SEQ ID NO: 347 - DNA, 21 bp, Artificial sequence
  Synthetic sequence: dsRNA targeting E6AP. Antisense strand (guide sequence) having double overhang
uuaggaucucgagaguauatt

SEQ ID NO: 348 - DNA, 21 bp, Artificial sequence
  Synthetic sequence: dsRNA targeting E6AP. Antisense strand (guide sequence) having double overhang
acauugugauacgucaagutt

SEQ ID NO: 349 - DNA, 21 bp, Artificial sequence
  Synthetic sequence: dsRNA targeting E6AP. Antisense strand (guide sequence) having double overhang
ucacuagauuucgacuguutt

SEQ ID NO: 350 - DNA, 21 bp, Artificial sequence
  Synthetic sequence: dsRNA targeting E6AP. Antisense strand (guide sequence) having double overhang
uucuccauuacgauaaugatt

SEQ ID NO: 351 - DNA, 21 bp, Artificial sequence
  Synthetic sequence: dsRNA targeting E6AP. Antisense strand (guide sequence) having double overhang
uagccagacccaguacuautt

SEQ ID NO: 352 - DNA, 21 bp, Artificial sequence
  Synthetic sequence: dsRNA targeting E6AP. Antisense strand (guide sequence) having double overhang
agucacauuccacguuaggtt

SEQ ID NO: 353 - DNA, 21 bp, Artificial sequence
  Synthetic sequence: dsRNA targeting E6AP. Antisense strand (guide sequence) having double overhang
aucaucucuagccggacaatt

SEQ ID NO: 354 - DNA, 21 bp, Artificial sequence
  Synthetic sequence: dsRNA targeting E6AP. Antisense strand (guide sequence) having double overhang
gucacauuccacguuaggutt

SEQ ID NO: 355 - DNA, 21 bp, Artificial sequence
  Synthetic sequence: dsRNA targeting E6AP. Antisense strand (guide sequence) having double overhang
acuagauuucgacuguuaatt

SEQ ID NO: 356 - DNA, 21 bp, Artificial sequence
  Synthetic sequence: dsRNA targeting E6AP. Antisense strand (guide sequence) having double overhang
agacccaguacuaugccaatt

SEQ ID NO: 357 - DNA, 21 bp, Artificial sequence
  Synthetic sequence: dsRNA targeting E6AP. Antisense strand (guide sequence) having double overhang
cccaagucacgaaaaguuctt

SEQ ID NO: 358 - DNA, 21 bp, Artificial sequence
  Synthetic sequence: dsRNA targeting E6AP. Antisense strand (guide sequence) having double overhang
cgaucaucucuagccggactt

SEQ ID NO: 359 - DNA, 21 bp, Artificial sequence
  Synthetic sequence: dsRNA targeting E6AP. Antisense strand (guide sequence) having double overhang
ucuuauaaagcucgagggctt

SEQ ID NO: 360 - DNA, 21 bp, Artificial sequence
  Synthetic sequence: dsRNA targeting E6AP. Antisense strand (guide sequence) having double overhang
uaaucuuauaaagcucgagtt

SEQ ID NO: 361 - DNA, 21 bp, Artificial sequence
  Synthetic sequence: dsRNA targeting E6AP. Antisense strand (guide sequence) having double overhang
cagacccaguacuaugccatt

SEQ ID NO: 362 - DNA, 21 bp, Artificial sequence
  Synthetic sequence: dsRNA targeting E6AP. Antisense strand (guide sequence) having double overhang
aagcacaaaacucauucgutt

SEQ ID NO: 363 - DNA, 21 bp, Artificial sequence
  Synthetic sequence: dsRNA targeting E6AP. Antisense strand (guide sequence) having double overhang
uauuauccauacgaagaaatt

SEQ ID NO: 364 - DNA, 21 bp, Artificial sequence
  Synthetic sequence: dsRNA targeting E6AP. Antisense strand (guide sequence) having double overhang
cuaugauauggucacgucutt

SEQ ID NO: 365 - DNA, 21 bp, Artificial sequence
  Synthetic sequence: dsRNA targeting E6AP. Antisense strand (guide sequence) having double overhang
auagccagacccaguacuatt

SEQ ID NO: 366 - DNA, 21 bp, Artificial sequence
  Synthetic sequence: dsRNA targeting E6AP. Antisense strand (guide sequence) having double overhang
cugcauuauuauccauacgtt

SEQ ID NO: 367 - DNA, 21 bp, Artificial sequence
  Synthetic sequence: dsRNA targeting E6AP. Antisense strand (guide sequence) having double overhang
caguuauuguaaauagccatt

SEQ ID NO: 368 - DNA, 21 bp, Artificial sequence
  Synthetic sequence: dsRNA targeting E6AP. Antisense strand (guide sequence) having double overhang
uucacuguacaugcgaauutt

SEQ ID NO: 369 - DNA, 21 bp, Artificial sequence
  Synthetic sequence: dsRNA targeting E6AP. Antisense strand (guide sequence) having double overhang
uguacaugcgaauucuauutt

SEQ ID NO: 370 - DNA, 21 bp, Artificial sequence
  Synthetic sequence: dsRNA targeting E6AP. Antisense strand (guide sequence) having double overhang
auacaucauuggguuaccatt

SEQ ID NO: 371 - DNA, 21 bp, Artificial sequence
  Synthetic sequence: dsRNA targeting E6AP. Antisense strand (guide sequence) having double overhang
ggaaaucuagauuccggcutt

SEQ ID NO: 372 - DNA, 21 bp, Artificial sequence
  Synthetic sequence: dsRNA targeting E6AP. Antisense strand (guide sequence) having double overhang
cucccaagucacgaaaagutt

SEQ ID NO: 373 - DNA, 21 bp, Artificial sequence
  Synthetic sequence: dsRNA targeting E6AP. Antisense strand (guide sequence) having double overhang
cuuauaaagcucgagggcutt

SEQ ID NO: 374 - DNA, 21 bp, Artificial sequence
  Synthetic sequence: dsRNA targeting E6AP. Antisense strand (guide sequence) having double overhang
gaacagugauucuucguuctt

SEQ ID NO: 375 - DNA, 21 bp, Artificial sequence
  Synthetic sequence: dsRNA targeting E6AP. Antisense strand (guide sequence) having double overhang
ugagaauguagucagaauatt

SEQ ID NO: 376 - DNA, 21 bp, Artificial sequence
  Synthetic sequence: dsRNA targeting E6AP. Antisense strand (guide sequence) having double overhang
guagcguucuauuagaugctt

SEQ ID NO: 377 - DNA, 21 bp, Artificial sequence
  Synthetic sequence: dsRNA targeting E6AP. Antisense strand (guide sequence) having double overhang
aucauucacuagauuucgatt

SEQ ID NO: 378 - DNA, 21 bp, Artificial sequence
  Synthetic sequence: dsRNA targeting E6AP. Antisense strand (guide sequence) having double overhang
cauucacuagauuucgacutt

SEQ ID NO: 379 - DNA, 21 bp, Artificial sequence
  Synthetic sequence: dsRNA targeting E6AP. Antisense strand (guide sequence) having double overhang
aucaauucuagcgccuuuctt

SEQ ID NO: 380 - DNA, 21 bp, Artificial sequence
  Synthetic sequence: dsRNA targeting E6AP. Antisense strand (guide sequence) having double overhang
aaucaauucuagcgccuuutt

SEQ ID NO: 381 - DNA, 21 bp, Artificial sequence
  Synthetic sequence: dsRNA targeting E6AP. Antisense strand (guide sequence) having double overhang
aaaaucaauucuagcgccutt

SEQ ID NO: 382 - DNA, 21 bp, Artificial sequence
  Synthetic sequence: dsRNA targeting E6AP. Antisense strand (guide sequence) having double overhang
uagcguucuauuagaugcutt

SEQ ID NO: 383 - DNA, 21 bp, Artificial sequence
  Synthetic sequence: dsRNA targeting E6AP. Antisense strand (guide sequence) having double overhang
uagcuugcucaucgcuuugtt

SEQ ID NO: 384 - DNA, 21 bp, Artificial sequence
  Synthetic sequence: dsRNA targeting E6AP. Antisense strand (guide sequence) having double overhang
uuccuguagacaaccauggtt

SEQ ID NO: 385 - DNA, 21 bp, Artificial sequence
  Synthetic sequence: dsRNA targeting E6AP. Antisense strand (guide sequence) having double overhang
ucaauucuagcgccuuucutt

SEQ ID NO: 386 - DNA, 21 bp, Artificial sequence
  Synthetic sequence: dsRNA targeting E6AP. Antisense strand (guide sequence) having double overhang
aacuggugguaguagcguutt

SEQ ID NO: 387 - DNA, 21 bp, Artificial sequence
  Synthetic sequence: dsRNA targeting E6AP. Antisense strand (guide sequence) having double overhang
uuaaaaucaauucuagcgctt

SEQ ID NO: 388 - DNA, 21 bp, Artificial sequence
  Synthetic sequence: dsRNA targeting E6AP. Antisense strand (guide sequence) having double overhang
ugcaacacugaucacgugctt

SEQ ID NO: 389 - DNA, 21 bp, Artificial sequence
  Synthetic sequence: dsRNA targeting E6AP. Antisense strand (guide sequence) having double overhang
uuuguacugggacacuauctt

SEQ ID NO: 390 - DNA, 21 bp, Artificial sequence
  Synthetic sequence: dsRNA targeting E6AP. Antisense strand (guide sequence) having double overhang
uguaacacuuucacgcaaatt

SEQ ID NO: 391 - DNA, 21 bp, Artificial sequence
  Synthetic sequence: dsRNA targeting E6AP. Antisense strand (guide sequence) having double overhang
caaaaaaguagcacauacutt

SEQ ID NO: 392 - DNA, 21 bp, Artificial sequence
  Synthetic sequence: dsRNA targeting E6AP. Antisense strand (guide sequence) having double overhang
acacaugaagacgacauactt

SEQ ID NO: 393 - DNA, 21 bp, Artificial sequence
  Synthetic sequence: dsRNA targeting E6AP. Antisense strand (guide sequence) having double overhang
ugcaauaggcuugacuacctt

SEQ ID NO: 394 - DNA, 21 bp, Artificial sequence
  Synthetic sequence: dsRNA targeting E6AP. Antisense strand (guide sequence) having double overhang
acauacuugaagguuacgutt

SEQ ID NO: 395 - DNA, 21 bp, Artificial sequence
  Synthetic sequence: dsRNA targeting E6AP. Antisense strand (guide sequence) having double overhang
uacuugaagguuacguggutt

SEQ ID NO: 396 - DNA, 21 bp, Artificial sequence
  Synthetic sequence: dsRNA targeting E6AP. Antisense strand (guide sequence) having double overhang
uuuccaggucagcuuacugtt

SEQ ID NO: 397 - DNA, 21 bp, Artificial sequence
  Synthetic sequence: dsRNA targeting E6AP. Antisense strand (guide sequence) having double overhang
ucaguaauguaaaccuacutt

SEQ ID NO: 398 - DNA, 21 bp, Artificial sequence
  Synthetic sequence: dsRNA targeting E6AP. Antisense strand (guide sequence) having double overhang
aauaggcuugacuaccauutt

SEQ ID NO: 399 - DNA, 21 bp, Artificial sequence
  Synthetic sequence: dsRNA targeting E6AP. Antisense strand (guide sequence) having double overhang
uaacuuuguugcaauaggctt

SEQ ID NO: 400 - DNA, 21 bp, Artificial sequence
  Synthetic sequence: dsRNA targeting E6AP. Antisense strand (guide sequence) having double overhang
acuugaagguuacgugguctt

SEQ ID NO: 401 - DNA, 21 bp, Artificial sequence
  Synthetic sequence: dsRNA targeting E6AP. Antisense strand (guide sequence) having double overhang
augaaaguaacguuuaacatt

SEQ ID NO: 402 - DNA, 21 bp, Artificial sequence
  Synthetic sequence: dsRNA targeting E6AP. Antisense strand (guide sequence) having double overhang
ucauucggcuagcuucaautt

SEQ ID NO: 403 - DNA, 21 bp, Artificial sequence
  Synthetic sequence: dsRNA targeting E6AP. Antisense strand (guide sequence) having double overhang
aauuuaucccucguuauautt

SEQ ID NO: 404 - DNA, 21 bp, Artificial sequence
  Synthetic sequence: dsRNA targeting E6AP. Antisense strand (guide sequence) having double overhang
aucuagguaauaaguaagutt

SEQ ID NO: 405 - DNA, 21 bp, Artificial sequence
  Synthetic sequence: dsRNA targeting E6AP. Antisense strand (guide sequence) having double overhang
uaaaacaacaacgagaacatt

SEQ ID NO: 406 - DNA, 21 bp, Artificial sequence
  Synthetic sequence: dsRNA targeting E6AP. Antisense strand (guide sequence) having double overhang
agugauuuaacccuuaaaatt

SEQ ID NO: 407 - DNA, 21 bp, Artificial sequence
  Synthetic sequence: dsRNA targeting E6AP. Antisense strand (guide sequence) having double overhang
aauuuguugugcuguuacutt

SEQ ID NO: 408 - DNA, 21 bp, Artificial sequence
  Synthetic sequence: dsRNA targeting E6AP. Antisense strand (guide sequence) having double overhang
uaucucagagcaggaguugtt

SEQ ID NO: 409 - DNA, 21 bp, Artificial sequence
  Synthetic sequence: dsRNA targeting E6AP. Antisense strand (guide sequence) having double overhang
cuguuaaguaagucacauctt

SEQ ID NO: 410 - DNA, 21 bp, Artificial sequence
  Synthetic sequence: dsRNA targeting E6AP. Antisense strand (guide sequence) having double overhang
auucuccauuacgauaaugtt

SEQ ID NO: 411 - DNA, 21 bp, Artificial sequence
  Synthetic sequence: dsRNA targeting E6AP. Antisense strand (guide sequence) having double overhang
acgugccucgauaaaauggtt

SEQ ID NO: 412 - DNA, 21 bp, Artificial sequence
  Synthetic sequence: dsRNA targeting E6AP. Antisense strand (guide sequence) having double overhang
agaaagaggauuggcuacutt

SEQ ID NO: 413 - DNA, 21 bp, Artificial sequence
  Synthetic sequence: dsRNA targeting E6AP. Antisense strand (guide sequence) having double overhang
ugguaguagcguucuauuatt

SEQ ID NO: 414 - DNA, 21 bp, Artificial sequence
  Synthetic sequence: dsRNA targeting E6AP. Antisense strand (guide sequence) having double overhang
ugacuacaguugcacgaagtt

SEQ ID NO: 415 - DNA, 21 bp, Artificial sequence
  Synthetic sequence: dsRNA targeting E6AP. Antisense strand (guide sequence) having double overhang
uucauuggucaccauaugatt

SEQ ID NO: 416 - DNA, 21 bp, Artificial sequence
  Synthetic sequence: dsRNA targeting E6AP. Antisense strand (guide sequence) having double overhang
uuccaauaacacggauuaatt

SEQ ID NO: 417 - DNA, 21 bp, Artificial sequence
  Synthetic sequence: dsRNA targeting E6AP. Antisense strand (guide sequence) having double overhang
uuucaucaagguagcguautt

SEQ ID NO: 418 - DNA, 21 bp, Artificial sequence
  Synthetic sequence: dsRNA targeting E6AP. Antisense strand (guide sequence) having double overhang
ucgcuucauucggcuagcutt

SEQ ID NO: 419 - DNA, 21 bp, Artificial sequence
  Synthetic sequence: dsRNA targeting E6AP. Antisense strand (guide sequence) having double overhang
caucaagguagcguauguatt

SEQ ID NO: 420 - DNA, 21 bp, Artificial sequence
  Synthetic sequence: dsRNA targeting E6AP. Antisense strand (guide sequence) having double overhang
auuuaucccucguuauauutt

SEQ ID NO: 421 - DNA, 21 bp, Artificial sequence
  Synthetic sequence: dsRNA targeting E6AP. Antisense strand (guide sequence) having double overhang
uuaaaacaacaacgagaactt

SEQ ID NO: 422 - DNA, 21 bp, Artificial sequence
  Synthetic sequence: dsRNA targeting E6AP. Antisense strand (guide sequence) having double overhang
uaaaacaaucagucaaucatt

SEQ ID NO: 423 - DNA, 21 bp, Artificial sequence
  Synthetic sequence: dsRNA targeting E6AP. Antisense strand (guide sequence) having double overhang
uccaauaacacggauuaaatt

SEQ ID NO: 424 - DNA, 21 bp, Artificial sequence
  Synthetic sequence: dsRNA targeting E6AP. Antisense strand (guide sequence) having double overhang
gaucaucucuagccggacatt

SEQ ID NO: 425 - DNA, 21 bp, Artificial sequence
  Synthetic sequence: dsRNA targeting E6AP. Antisense strand (guide sequence) having double overhang
cucgcuucauucggcuagctt

SEQ ID NO: 426 - DNA, 21 bp, Artificial sequence
  Synthetic sequence: dsRNA targeting E6AP. Antisense strand (guide sequence) having double overhang
aucaagguagcguauguactt

SEQ ID NO: 427 - DNA, 21 bp, Artificial sequence
  Synthetic sequence: dsRNA targeting E6AP. Antisense strand (guide sequence) having double overhang
uuaaucuuauaaagcucgatt

SEQ ID NO: 428 - DNA, 21 bp, Artificial sequence
  Synthetic sequence: dsRNA targeting E6AP. Antisense strand (guide sequence) having double overhang
cucaguuaacuggugguagtt

SEQ ID NO: 429 - DNA, 21 bp, Artificial sequence
  Synthetic sequence: dsRNA targeting E6AP. Antisense strand (guide sequence) having double overhang
aucacgugccucgauaaaatt

SEQ ID NO: 430 - DNA, 21 bp, Artificial sequence
  Synthetic sequence: dsRNA targeting E6AP. Antisense strand (guide sequence) having double overhang
ucacgugccucgauaaaautt

SEQ ID NO: 431 - DNA, 21 bp, Artificial sequence
  Synthetic sequence: dsRNA targeting E6AP. Antisense strand (guide sequence) having double overhang
aguacaugaaaguaacguutt

SEQ ID NO: 432 - DNA, 21 bp, Artificial sequence
  Synthetic sequence: dsRNA targeting E6AP. Antisense strand (guide sequence) having double overhang
cacuguacaugcgaauucutt

SEQ ID NO: 433 - DNA, 21 bp, Artificial sequence
  Synthetic sequence: dsRNA targeting E6AP. Antisense strand (guide sequence) having double overhang
aauccuuuggcauacgugatt

SEQ ID NO: 434 - DNA, 21 bp, Artificial sequence
  Synthetic sequence: dsRNA targeting E6AP. Antisense strand (guide sequence) having double overhang
ccaauaacacggauuaaagtt

SEQ ID NO: 435 - DNA, 21 bp, Artificial sequence
  Synthetic sequence: dsRNA targeting E6AP. Antisense strand (guide sequence) having double overhang
ucaucaagguagcguaugutt

SEQ ID NO: 436 - DNA, 21 bp, Artificial sequence
  Synthetic sequence: dsRNA targeting E6AP. Antisense strand (guide sequence) having double overhang
cauacacagaagacuaggatt

SEQ ID NO: 437 - DNA, 21 bp, Artificial sequence
  Synthetic sequence: dsRNA targeting E6AP. Antisense strand (guide sequence) having double overhang
cacgugccucgauaaaaugtt

SEQ ID NO: 438 - DNA, 21 bp, Artificial sequence
  Synthetic sequence: dsRNA targeting E6AP. Antisense strand (guide sequence) having double overhang
aucuacaguaaucaguuaatt

SEQ ID NO: 439 - DNA, 21 bp, Artificial sequence
  Synthetic sequence: dsRNA targeting E6AP. Antisense strand (guide sequence) having double overhang
gacuacaguugcacgaaggtt

SEQ ID NO: 440 - DNA, 21 bp, Artificial sequence
  Synthetic sequence: dsRNA targeting E6AP. Antisense strand (guide sequence) having double overhang
uagcguauguacccuaacatt

SEQ ID NO: 441 - DNA, 21 bp, Artificial sequence
  Synthetic sequence: dsRNA targeting E6AP. Antisense strand (guide sequence) having double overhang
cguauguacccuaacagugtt

SEQ ID NO: 442 - DNA, 21 bp, Artificial sequence
  Synthetic sequence: dsRNA targeting E6AP. Antisense strand (guide sequence) having double overhang
uauggugaaaagugccacatt

SEQ ID NO: 443 - DNA, 21 bp, Artificial sequence
  Synthetic sequence: dsRNA targeting E6AP. Antisense strand (guide sequence) having double overhang
auccuuuggcauacgugautt

SEQ ID NO: 444 - DNA, 21 bp, Artificial sequence
  Synthetic sequence: dsRNA targeting E6AP. Antisense strand (guide sequence) having double overhang
aagguagcguauguacccutt

SEQ ID NO: 445 - DNA, 21 bp, Artificial sequence
  Synthetic sequence: dsRNA targeting E6AP. Antisense strand (guide sequence) having double overhang
aucaaugucucaccuuagutt

SEQ ID NO: 446 - DNA, 21 bp, Artificial sequence
  Synthetic sequence: dsRNA targeting E6AP. Antisense strand (guide sequence) having double overhang
cauuccacguuaggugacatt

SEQ ID NO: 447 - DNA, 21 bp, Artificial sequence
  Synthetic sequence: dsRNA targeting E6AP. Antisense strand (guide sequence) having double overhang
cuguacaugcgaauucuautt

SEQ ID NO: 448 - DNA, 21 bp, Artificial sequence
  Synthetic sequence: dsRNA targeting E6AP. Antisense strand (guide sequence) having double overhang
gagucucccaagucacgaatt

SEQ ID NO: 449 - DNA, 21 bp, Artificial sequence
  Synthetic sequence: dsRNA targeting E6AP. Antisense strand (guide sequence) having double overhang
acuguacaugcgaauucuatt

SEQ ID NO: 450 - DNA, 21 bp, Artificial sequence
  Synthetic sequence: dsRNA targeting E6AP. Antisense strand (guide sequence) having double overhang
auuauauaaaacgcccucatt

SEQ ID NO: 451 - DNA, 21 bp, Artificial sequence
  Synthetic sequence: dsRNA targeting E6AP. Antisense strand (guide sequence) having double overhang
guauguacccuaacagugutt

SEQ ID NO: 452 - DNA, 21 bp, Artificial sequence
  Synthetic sequence: dsRNA targeting E6AP. Antisense strand (guide sequence) having double overhang
cuuaaaacaacaacgagaatt

SEQ ID NO: 453 - DNA, 21 bp, Artificial sequence
  Synthetic sequence: dsRNA targeting E6AP. Antisense strand (guide sequence) having double overhang
agcguauguacccuaacagtt

SEQ ID NO: 454 - DNA, 21 bp, Artificial sequence
  Synthetic sequence: dsRNA targeting E6AP. Antisense strand (guide sequence) having double overhang
augucucaccuuaguuaaatt

SEQ ID NO: 455 - DNA, 21 bp, Artificial sequence
  Synthetic sequence: dsRNA targeting E6AP. Antisense strand (guide sequence) having double overhang
cacuagauuucgacuguuatt

SEQ ID NO: 456 - DNA, 21 bp, Artificial sequence
  Synthetic sequence: dsRNA targeting E6AP. Antisense strand (guide sequence) having double overhang
gcauuguauuuagaccacatt

SEQ ID NO: 457 - DNA, 21 bp, Artificial sequence
  Synthetic sequence: dsRNA targeting E6AP. Antisense strand (guide sequence) having double overhang
cacauuccacguuaggugatt

SEQ ID NO: 458 - DNA, 21 bp, Artificial sequence
  Synthetic sequence: dsRNA targeting E6AP. Antisense strand (guide sequence) having double overhang
uccuuucauauacuaagaatt

SEQ ID NO: 459 - DNA, 21 bp, Artificial sequence
  Synthetic sequence: dsRNA targeting E6AP. Antisense strand (guide sequence) having double overhang
gugguaguagcguucuauutt

SEQ ID NO: 460 - DNA, 21 bp, Artificial sequence
  Synthetic sequence: dsRNA targeting E6AP. Antisense strand (guide sequence) having double overhang
uuauauaaaacgcccucagtt

SEQ ID NO: 461 - DNA, 21 bp, Artificial sequence
  Synthetic sequence: dsRNA targeting E6AP. Antisense strand (guide sequence) having double overhang
guaaaugaaugaacgauuutt

SEQ ID NO: 462 - DNA, 21 bp, Artificial sequence
  Synthetic sequence: dsRNA targeting E6AP. Antisense strand (guide sequence) having double overhang
gucucccaagucacgaaaatt

SEQ ID NO: 463 - DNA, 21 bp, Artificial sequence
  Synthetic sequence: dsRNA targeting E6AP. Antisense strand (guide sequence) having double overhang
gaugacuacaguugcacgatt

SEQ ID NO: 464 - DNA, 21 bp, Artificial sequence
  Synthetic sequence: dsRNA targeting E6AP. Antisense strand (guide sequence) having double overhang
aggucagcuuacuguaugatt

SEQ ID NO: 465 - DNA, 21 bp, Artificial sequence
  Synthetic sequence: dsRNA targeting E6AP. Antisense strand (guide sequence) having double overhang
agaugacuacaguugcacgtt

SEQ ID NO: 466 - DNA, 21 bp, Artificial sequence
  Synthetic sequence: dsRNA targeting E6AP. Antisense strand (guide sequence) having double overhang
guagacccuucuaauggcatt

SEQ ID NO: 467 - DNA, 21 bp, Artificial sequence
  Synthetic sequence: dsRNA targeting E6AP. Antisense strand (guide sequence) having double overhang
caguauacaguuauuguaatt

SEQ ID NO: 468 - DNA, 21 bp, Artificial sequence
  Synthetic sequence: dsRNA targeting E6AP. Antisense strand (guide sequence) having double overhang
cguucacuguacaugcgaatt

SEQ ID NO: 469 - DNA, 21 bp, Artificial sequence
  Synthetic sequence: dsRNA targeting E6AP; sense strand
auacgaugaaucuacaaaatt

SEQ ID NO: 470 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
auacgaugaaucuacaaaatt

SEQ ID NO: 471 - DNA, 21 bp, Artificial sequence
  Synthetic sequence: Chemically modified dsRNA targeting E6AP; sense strand
  modified_base (2)..(2): um
  modified_base (4)..(4): cm
  modified_base (7)..(7): um
  modified_base (11)..(11): um
  modified_base (12)..(12): cm
  modified_base (13)..(13): um
  modified_base (15)..(15): cm
  misc_feature (20)..(20): t is deoxy-thymidine - 5prime - phosphorothioate
auacgaugaaucuacaaaatt

SEQ ID NO: 472 - DNA, 21 bp, Artificial sequence
  Synthetic sequence: Chemically modified dsRNA targeting E6AP; sense strand
  modified_base (2)..(2): um
  modified_base (4)..(4): cm
  modified_base (7)..(7): um
  modified_base (11)..(11): um
  modified_base (12)..(12): cm
  modified_base (13)..(13): um
  modified_base (15)..(15): cm
  misc_feature (20)..(20): t is deoxy-thymidine - 5prime - phosphorothioate
auacgaugaaucuacaaaatt

SEQ ID NO: 473 - DNA, 21 bp, Artificial sequence
  Synthetic sequence: Chemically modified dsRNA targeting E6AP; sense strand
  misc_feature (21)..(21): terminal t linked to a cholesterol derivative
auacgaugaaucuacaaaatt

SEQ ID NO: 474 - DNA, 21 bp, Artificial sequence
  Synthetic sequence: Chemically modified dsRNA targeting E6AP; sense strand
  modified_base (2)..(2): um
  modified_base (4)..(4): cm
  modified_base (7)..(7): um
  modified_base (11)..(11): um
  modified_base (12)..(12): cm
  modified_base (13)..(13): um
  modified_base (15)..(15): cm
  misc_feature (21)..(21): terminal t linked to a cholesterol derivative
auacgaugaaucuacaaaatt

SEQ ID NO: 475 - DNA, 21 bp, Artificial sequence
  Synthetic sequence: Chemically modified dsRNA targeting E6AP; sense strand
  modified_base (2)..(2): um
  modified_base (4)..(4): cm
  modified_base (7)..(7): um
  modified_base (11)..(11): um
  modified_base (12)..(12): cm
  modified_base (13)..(13): um
  modified_base (15)..(15): cm
  misc_feature (21)..(21): terminal t linked to a cholesterol derivative
auacgaugaaucuacaaaatt

SEQ ID NO: 476 - DNA, 21 bp, Artificial sequence
  Synthetic sequence: dsRNA targeting E6AP; sense strand
ugacuacauucucaauaaatt

SEQ ID NO: 477 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
ugacuacauucucaauaaatt

SEQ ID NO: 478 - DNA, 21 bp, Artificial sequence
  Synthetic sequence: Chemically modified dsRNA targeting E6AP; sense strand
  modified_base (1)..(1): um
  modified_base (4)..(4): cm
  modified_base (5)..(5): um
  modified_base (7)..(7): cm
  modified_base (9)..(10): um
  modified_base (11)..(11): cm
  modified_base (12)..(12): um
  modified_base (13)..(13): cm
  modified_base (16)..(16): um
  misc_feature (20)..(20): t is deoxy-thymidine - 5prime - phosphorothioate
ugacuacauucucaauaaatt

SEQ ID NO: 479 - DNA, 21 bp, Artificial sequence
  Synthetic sequence: Chemically modified dsRNA targeting E6AP; sense strand
  modified_base (1)..(1): um
  modified_base (4)..(4): cm
  modified_base (5)..(5): um
  modified_base (7)..(7): cm
  modified_base (9)..(10): um
  modified_base (11)..(11): cm
  modified_base (12)..(12): um
  modified_base (13)..(13): cm
  modified_base (16)..(16): um
  misc_feature (20)..(20): t is deoxy-thymidine - 5prime - phosphorothioate
ugacuacauucucaauaaatt

SEQ ID NO: 480 - DNA, 21 bp, Artificial sequence
  Synthetic sequence: Chemically modified dsRNA targeting E6AP; sense strand
  misc_feature (21)..(21): terminal t linked to a cholesterol derivative
ugacuacauucucaauaaatt

SEQ ID NO: 481 - DNA, 21 bp, Artificial sequence
  Synthetic sequence: Chemically modified dsRNA targeting E6AP; sense strand
  modified_base (1)..(1): um
  modified_base (4)..(4): cm
  modified_base (5)..(5): um
  modified_base (7)..(7): cm
  modified_base (9)..(10): um
  modified_base (11)..(11): cm
  modified_base (12)..(12): um
  modified_base (13)..(13): cm
  modified_base (16)..(16): um
  misc_feature (21)..(21): terminal t linked to a cholesterol derivative
ugacuacauucucaauaaatt

SEQ ID NO: 482 - DNA, 21 bp, Artificial sequence
  Synthetic sequence: Chemically modified dsRNA targeting E6AP; sense strand
  modified_base (1)..(1): um
  modified_base (4)..(4): cm
  modified_base (5)..(5): um
  modified_base (7)..(7): cm
  modified_base (9)..(10): um
  modified_base (11)..(11): cm
  modified_base (12)..(12): um
  modified_base (13)..(13): cm
  modified_base (16)..(16): um
  misc_feature (21)..(21): terminal t linked to a cholesterol derivative
ugacuacauucucaauaaatt

SEQ ID NO: 483 - DNA, 21 bp, Artificial sequence
  Synthetic sequence: dsRNA targeting E6AP; sense strand
agccugcacgaaugaguuutt

SEQ ID NO: 484 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
agccugcacgaaugaguuutt

SEQ ID NO: 485 - DNA, 21 bp, Artificial sequence
  Synthetic sequence: Chemically modified dsRNA targeting E6AP; sense strand
  modified_base (3)..(4): cm
  modified_base (5)..(5): um
  modified_base (7)..(7): cm
  modified_base (9)..(9): cm
  modified_base (13)..(13): um
  modified_base (17)..(19): um
  misc_feature (20)..(20): t is deoxy-thymidine - 5prime - phosphorothioate
agccugcacgaaugaguuutt

SEQ ID NO: 486 - DNA, 21 bp, Artificial sequence
  Synthetic sequence: Chemically modified dsRNA targeting E6AP; sense strand
  modified_base (3)..(4): cm
  modified_base (5)..(5): um
  modified_base (7)..(7): cm
  modified_base (9)..(9): cm
  modified_base (13)..(13): um
  modified_base (17)..(19): um
  misc_feature (20)..(20): t is deoxy-thymidine - 5prime - phosphorothioate
agccugcacgaaugaguuutt

SEQ ID NO: 487 - DNA, 21 bp, Artificial sequence
  Synthetic sequence: Chemically modified dsRNA targeting E6AP; sense strand
  misc_feature (21)..(21): terminal t linked to a cholesterol derivative
agccugcacgaaugaguuutt

SEQ ID NO: 488 - DNA, 21 bp, Artificial sequence
  Synthetic sequence: Chemically modified dsRNA targeting E6AP; sense strand
  modified_base (3)..(4): cm
  modified_base (5)..(5): um
  modified_base (7)..(7): cm
  modified_base (9)..(9): cm
  modified_base (13)..(13): um
  modified_base (17)..(19): um
  misc_feature (21)..(21): terminal t linked to a cholesterol derivative
agccugcacgaaugaguuutt

SEQ ID NO: 489 - DNA, 21 bp, Artificial sequence
  Synthetic sequence: Chemically modified dsRNA targeting E6AP; sense strand
  modified_base (3)..(4): cm
  modified_base (5)..(5): um
  modified_base (7)..(7): cm
  modified_base (9)..(9): cm
  modified_base (13)..(13): um
  modified_base (17)..(19): um
  misc_feature (21)..(21): terminal t linked to a cholesterol derivative
agccugcacgaaugaguuutt

SEQ ID NO: 490 - DNA, 21 bp, Artificial sequence
  Synthetic sequence: dsRNA targeting E6AP; sense strand
ggauugucgaaaaccacuutt

SEQ ID NO: 491 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
ggauugucgaaaaccacuutt

SEQ ID NO: 492 - DNA, 21 bp, Artificial sequence
  Synthetic sequence: Chemically modified dsRNA targeting E6AP; sense strand
  modified_base (4)..(5): um
  modified_base (7)..(7): um
  modified_base (8)..(8): cm
  modified_base (14)..(15): cm
  modified_base (17)..(17): cm
  modified_base (18)..(19): um
  misc_feature (20)..(20): t is deoxy-thymidine - 5prime - phosphorothioate
ggauugucgaaaaccacuutt

SEQ ID NO: 493 - DNA, 21 bp, Artificial sequence
  Synthetic sequence: Chemically modified dsRNA targeting E6AP; sense strand
  modified_base (4)..(5): um
  modified_base (7)..(7): um
  modified_base (8)..(8): cm
  modified_base (14)..(15): cm
  modified_base (17)..(17): cm
  modified_base (18)..(19): um
  misc_feature (20)..(20): t is deoxy-thymidine - 5prime - phosphorothioate
ggauugucgaaaaccacuutt

SEQ ID NO: 494 - DNA, 21 bp, Artificial sequence
  Synthetic sequence: Chemically modified dsRNA targeting E6AP; sense strand
  misc_feature (21)..(21): terminal t linked to a cholesterol derivative
ggauugucgaaaaccacuutt

SEQ ID NO: 495 - DNA, 21 bp, Artificial sequence
  Synthetic sequence: Chemically modified dsRNA targeting E6AP; sense strand
  modified_base (4)..(5): um
  modified_base (7)..(7): um
  modified_base (8)..(8): cm
  modified_base (14)..(15): cm
  modified_base (17)..(17): cm
  modified_base (18)..(19): um
  misc_feature (21)..(21): terminal t linked to a cholesterol derivative
ggauugucgaaaaccacuutt

SEQ ID NO: 496 - DNA, 21 bp, Artificial sequence
  Synthetic sequence: Chemically modified dsRNA targeting E6AP; sense strand
  modified_base (4)..(5): um
  modified_base (7)..(7): um
  modified_base (8)..(8): cm
  modified_base (14)..(15): cm
  modified_base (17)..(17): cm
  modified_base (18)..(19): um
  misc_feature (21)..(21): terminal t linked to a cholesterol derivative
ggauugucgaaaaccacuutt

SEQ ID NO: 497 - DNA, 21 bp, Artificial sequence
  Synthetic sequence: dsRNA targeting E6AP; sense strand
cucucgagauccuaauuautt

SEQ ID NO: 498 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
cucucgagauccuaauuautt

SEQ ID NO: 499 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (4)..(4): um
  modified_base (5)..(5): cm
  modified_base (10)..(10): um
  modified_base (11)..(12): cm
  modified_base (13)..(13): um
  modified_base (16)..(17): um
  modified_base (19)..(19): um
  misc_feature (20)..(20): t is deoxy-thymidine - 5prime - phosphorothioate
cucucgagauccuaauuautt

SEQ ID NO: 500 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (4)..(4): um
  modified_base (5)..(5): cm
  modified_base (10)..(10): um
  modified_base (11)..(12): cm
  modified_base (13)..(13): um
  modified_base (16)..(17): um
  modified_base (19)..(19): um
  misc_feature (20)..(20): t is deoxy-thymidine - 5prime - phosphorothioate
cucucgagauccuaauuautt

SEQ ID NO: 501 - DNA, 21 bp, Artificial sequence
  Synthetic sequence: Chemically modified dsRNA targeting E6AP; sense strand
  misc_feature (21)..(21): terminal t linked to a cholesterol derivative
cucucgagauccuaauuautt

SEQ ID NO: 502 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (4)..(4): um
  modified_base (5)..(5): cm
  modified_base (10)..(10): um
  modified_base (11)..(12): cm
  modified_base (13)..(13): um
  modified_base (16)..(17): um
  modified_base (19)..(19): um
  misc_feature (21)..(21): terminal t linked to a cholesterol derivative
cucucgagauccuaauuautt

SEQ ID NO: 503 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (4)..(4): um
  modified_base (5)..(5): cm
  modified_base (10)..(10): um
  modified_base (11)..(12): cm
  modified_base (13)..(13): um
  modified_base (16)..(17): um
  modified_base (19)..(19): um
  misc_feature (21)..(21): terminal t linked to a cholesterol derivative
cucucgagauccuaauuautt

SEQ ID NO: 504 - DNA, 21 bp, Artificial sequence
  Synthetic sequence: dsRNA targeting E6AP; sense strand
augugacuuacuuaacagatt

SEQ ID NO: 505 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
augugacuuacuuaacagatt

SEQ ID NO: 506 - DNA, 21 bp, Artificial sequence
  Synthetic sequence: Chemically modified dsRNA targeting E6AP; sense strand
  modified_base (2)..(2): um
  modified_base (4)..(4): um
  modified_base (7)..(7): cm
  modified_base (8)..(9): um
  modified_base (11)..(11): cm
  modified_base (12)..(13): um
  modified_base (16)..(16): cm
  misc_feature (20)..(20): t is deoxy-thymidine - 5prime - phosphorothioate
augugacuuacuuaacagatt

SEQ ID NO: 507 - DNA, 21 bp, Artificial sequence
  Synthetic sequence: Chemically modified dsRNA targeting E6AP; sense strand
  modified_base (2)..(2): um
  modified_base (4)..(4): um
  modified_base (7)..(7): cm
  modified_base (8)..(9): um
  modified_base (11)..(11): cm
  modified_base (12)..(13): um
  modified_base (16)..(16): cm
  misc_feature (20)..(20): t is deoxy-thymidine - 5prime - phosphorothioate
augugacuuacuuaacagatt

SEQ ID NO: 508 - DNA, 21 bp, Artificial sequence
  Synthetic sequence: Chemically modified dsRNA targeting E6AP; sense strand
  misc_feature (21)..(21): terminal t linked to a cholesterol derivative
augugacuuacuuaacagatt

SEQ ID NO: 509 - DNA, 21 bp, Artificial sequence
  Synthetic sequence: Chemically modified dsRNA targeting E6AP; sense strand
  modified_base (2)..(2): um
  modified_base (4)..(4): um
  modified_base (7)..(7): cm
  modified_base (8)..(9): um
  modified_base (11)..(11): cm
  modified_base (12)..(13): um
  modified_base (16)..(16): cm
  misc_feature (21)..(21): terminal t linked to a cholesterol derivative
augugacuuacuuaacagatt

SEQ ID NO: 510 - DNA, 21 bp, Artificial sequence
  Synthetic sequence: Chemically modified dsRNA targeting E6AP; sense strand
  modified_base (2)..(2): um
  modified_base (4)..(4): um
  modified_base (7)..(7): cm
  modified_base (8)..(9): um
  modified_base (11)..(11): cm
  modified_base (12)..(13): um
  modified_base (16)..(16): cm
  misc_feature (21)..(21): terminal t linked to a cholesterol derivative
augugacuuacuuaacagatt

SEQ ID NO: 511 - DNA, 21 bp, Artificial sequence
  Synthetic sequence: dsRNA targeting E6AP; sense strand
guauacucucgagauccuatt

SEQ ID NO: 512 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
guauacucucgagauccuatt

SEQ ID NO: 513 - DNA, 21 bp, Artificial sequence
  Synthetic sequence: Chemically modified dsRNA targeting E6AP; sense strand
  modified_base (2)..(2): um
  modified_base (4)..(4): um
  modified_base (6)..(6): cm
  modified_base (7)..(7): um
  modified_base (8)..(8): cm
  modified_base (9)..(9): um
  modified_base (10)..(10): cm
  modified_base (15)..(15): um
  modified_base (16)..(17): cm
  modified_base (18)..(18): um
  misc_feature (20)..(20): t is deoxy-thymidine - 5prime - phosphorothioate
guauacucucgagauccuatt

SEQ ID NO: 514 - DNA, 21 bp, Artificial sequence
  Synthetic sequence: Chemically modified dsRNA targeting E6AP; sense strand
  modified_base (2)..(2): um
  modified_base (4)..(4): um
  modified_base (6)..(6): cm
  modified_base (7)..(7): um
  modified_base (8)..(8): cm
  modified_base (9)..(9): um
  modified_base (10)..(10): cm
  modified_base (15)..(15): um
  modified_base (16)..(17): cm
  modified_base (18)..(18): um
  misc_feature (20)..(20): t is deoxy-thymidine - 5prime - phosphorothioate
guauacucucgagauccuatt

SEQ ID NO: 515 - DNA, 21 bp, Artificial sequence
  Synthetic sequence: Chemically modified dsRNA targeting E6AP; sense strand
  misc_feature (21)..(21): terminal t linked to a cholesterol derivative
guauacucucgagauccuatt

SEQ ID NO: 516 - DNA, 21 bp, Artificial sequence
  Synthetic sequence: Chemically modified dsRNA targeting E6AP; sense strand
  modified_base (2)..(2): um
  modified_base (4)..(4): um
  modified_base (6)..(6): cm
  modified_base (7)..(7): um
  modified_base (8)..(8): cm
  modified_base (9)..(9): um
  modified_base (10)..(10): cm
  modified_base (15)..(15): um
  modified_base (16)..(17): cm
  modified_base (18)..(18): um
  misc_feature (21)..(21): terminal t linked to a cholesterol derivative
guauacucucgagauccuatt

SEQ ID NO: 517 - DNA, 21 bp, Artificial sequence
  Synthetic sequence: Chemically modified dsRNA targeting E6AP; sense strand
  modified_base (2)..(2): um
  modified_base (4)..(4): um
  modified_base (6)..(6): cm
  modified_base (7)..(7): um
  modified_base (8)..(8): cm
  modified_base (9)..(9): um
  modified_base (10)..(10): cm
  modified_base (15)..(15): um
  modified_base (16)..(17): cm
  modified_base (18)..(18): um
  misc_feature (21)..(21): terminal t linked to a cholesterol derivative
guauacucucgagauccuatt

SEQ ID NO: 518 - DNA, 21 bp, Artificial sequence
  Synthetic sequence: dsRNA targeting E6AP; sense strand
agguuaccuacaucucauatt

SEQ ID NO: 519 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
agguuaccuacaucucauatt

SEQ ID NO: 520 - DNA, 21 bp, Artificial sequence
  Synthetic sequence: Chemically modified dsRNA targeting E6AP; sense strand
  modified_base (4)..(5): um
  modified_base (7)..(8): cm
  modified_base (9)..(9): um
  modified_base (11)..(11): cm
  modified_base (13)..(13): um
  modified_base (14)..(14): cm
  modified_base (15)..(15): um
  modified_base (16)..(16): cm
  modified_base (18)..(18): um
  misc_feature (20)..(20): t is deoxy-thymidine - 5prime - phosphorothioate
agguuaccuacaucucauatt

SEQ ID NO: 521 - DNA, 21 bp, Artificial sequence
  Synthetic sequence: Chemically modified dsRNA targeting E6AP; sense strand
  modified_base (4)..(5): um
  modified_base (7)..(8): cm
  modified_base (9)..(9): um
  modified_base (11)..(11): cm
  modified_base (13)..(13): um
  modified_base (14)..(14): cm
  modified_base (15)..(15): um
  modified_base (16)..(16): cm
  modified_base (18)..(18): um
  misc_feature (20)..(20): t is deoxy-thymidine - 5prime - phosphorothioate
agguuaccuacaucucauatt

SEQ ID NO: 522 - DNA, 21 bp, Artificial sequence
  Synthetic sequence: Chemically modified dsRNA targeting E6AP; sense strand
  misc_feature (21)..(21): terminal t linked to a cholesterol derivative
agguuaccuacaucucauatt

SEQ ID NO: 523 - DNA, 21 bp, Artificial sequence
  Synthetic sequence: Chemically modified dsRNA targeting E6AP; sense strand
  modified_base (4)..(5): um
  modified_base (7)..(8): cm
  modified_base (9)..(9): um
  modified_base (11)..(11): cm
  modified_base (13)..(13): um
  modified_base (14)..(14): cm
  modified_base (15)..(15): um
  modified_base (16)..(16): cm
  modified_base (18)..(18): um
  misc_feature (21)..(21): terminal t linked to a cholesterol derivative
agguuaccuacaucucauatt

SEQ ID NO: 524 - DNA, 21 bp, Artificial sequence
  Synthetic sequence: Chemically modified dsRNA targeting E6AP; sense strand
  modified_base (4)..(5): um
  modified_base (7)..(8): cm
  modified_base (9)..(9): um
  modified_base (11)..(11): cm
  modified_base (13)..(13): um
  modified_base (14)..(14): cm
  modified_base (15)..(15): um
  modified_base (16)..(16): cm
  modified_base (18)..(18): um
  misc_feature (21)..(21): terminal t linked to a cholesterol derivative
agguuaccuacaucucauatt

SEQ ID NO: 525 - DNA, 21 bp, Artificial sequence
  Synthetic sequence: dsRNA targeting E6AP; sense strand
aguacuuauucagaccagatt

SEQ ID NO: 526 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
aguacuuauucagaccagatt

SEQ ID NO: 527 - DNA, 21 bp, Artificial sequence
  Synthetic sequence: Chemically modified dsRNA targeting E6AP; sense strand
  modified_base (3)..(3): um
  modified_base (5)..(5): cm
  modified_base (6)..(7): um
  modified_base (9)..(10): um
  modified_base (11)..(11): cm
  modified_base (15)..(16): cm
  misc_feature (20)..(20): t is deoxy-thymidine - 5prime - phosphorothioate
aguacuuauucagaccagatt

SEQ ID NO: 528 - DNA, 21 bp, Artificial sequence
  Synthetic sequence: Chemically modified dsRNA targeting E6AP; sense strand
  modified_base (3)..(3): um
  modified_base (5)..(5): cm
  modified_base (6)..(7): um
  modified_base (9)..(10): um
  modified_base (11)..(11): cm
  modified_base (15)..(16): cm
  misc_feature (20)..(20): t is deoxy-thymidine - 5prime - phosphorothioate
aguacuuauucagaccagatt

SEQ ID NO: 529 - DNA, 21 bp, Artificial sequence
  Synthetic sequence: Chemically modified dsRNA targeting E6AP; sense strand
  misc_feature (21)..(21): terminal t linked to a cholesterol derivative
aguacuuauucagaccagatt

SEQ ID NO: 530 - DNA, 21 bp, Artificial sequence
  Synthetic sequence: Chemically modified dsRNA targeting E6AP; sense strand
  modified_base (3)..(3): um
  modified_base (5)..(5): cm
  modified_base (6)..(7): um
  modified_base (9)..(10): um
  modified_base (11)..(11): cm
  modified_base (15)..(16): cm
  misc_feature (21)..(21): terminal t linked to a cholesterol derivative
aguacuuauucagaccagatt

SEQ ID NO: 531 - DNA, 21 bp, Artificial sequence
  Synthetic sequence: Chemically modified dsRNA targeting E6AP; sense strand
  modified_base (3)..(3): um
  modified_base (5)..(5): cm
  modified_base (6)..(7): um
  modified_base (9)..(10): um
  modified_base (11)..(11): cm
  modified_base (15)..(16): cm
  misc_feature (21)..(21): terminal t linked to a cholesterol derivative
aguacuuauucagaccagatt

SEQ ID NO: 532 - DNA, 21 bp, Artificial sequence
  Synthetic sequence: dsRNA targeting E6AP; sense strand
auccuaauuaucugaauuutt

SEQ ID NO: 533 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
auccuaauuaucugaauuutt

SEQ ID NO: 534 - DNA, 21 bp, Artificial sequence
  Synthetic sequence: Chemically modified dsRNA targeting E6AP; sense strand
  modified_base (2)..(2): um
  modified_base (3)..(4): cm
  modified_base (5)..(5): um
  modified_base (8)..(9): um
  modified_base (11)..(11): um
  modified_base (12)..(12): cm
  modified_base (13)..(13): um
  modified_base (17)..(19): um
  misc_feature (20)..(20): t is deoxy-thymidine - 5prime - phosphorothioate
auccuaauuaucugaauuutt

SEQ ID NO: 535 - DNA, 21 bp, Artificial sequence
  Synthetic sequence: Chemically modified dsRNA targeting E6AP; sense strand
  modified_base (2)..(2): um
  modified_base (3)..(4): cm
  modified_base (5)..(5): um
  modified_base (8)..(9): um
  modified_base (11)..(11): um
  modified_base (12)..(12): cm
  modified_base (13)..(13): um
  modified_base (17)..(19): um
  misc_feature (20)..(20): t is deoxy-thymidine - 5prime - phosphorothioate
auccuaauuaucugaauuutt

SEQ ID NO: 536 - DNA, 21 bp, Artificial sequence
  Synthetic sequence: Chemically modified dsRNA targeting E6AP; sense strand
  misc_feature (21)..(21): terminal t linked to a cholesterol derivative
auccuaauuaucugaauuutt

SEQ ID NO: 537 - DNA, 21 bp, Artificial sequence
  Synthetic sequence: Chemically modified dsRNA targeting E6AP; sense strand
  modified_base (2)..(2): um
  modified_base (3)..(4): cm
  modified_base (5)..(5): um
  modified_base (8)..(9): um
  modified_base (11)..(11): um
  modified_base (12)..(12): cm
  modified_base (13)..(13): um
  modified_base (17)..(19): um
  misc_feature (21)..(21): terminal t linked to a cholesterol derivative
auccuaauuaucugaauuutt

SEQ ID NO: 538 - DNA, 21 bp, Artificial sequence
  Synthetic sequence: Chemically modified dsRNA targeting E6AP; sense strand
  modified_base (2)..(2): um
  modified_base (3)..(4): cm
  modified_base (5)..(5): um
  modified_base (8)..(9): um
  modified_base (11)..(11): um
  modified_base (12)..(12): cm
  modified_base (13)..(13): um
  modified_base (17)..(19): um
  misc_feature (21)..(21): terminal t linked to a cholesterol derivative
auccuaauuaucugaauuutt

SEQ ID NO: 539 - DNA, 21 bp, Artificial sequence
  Synthetic sequence: dsRNA targeting E6AP; sense strand
aaggauaggugauagcucatt

SEQ ID NO: 540 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
aaggauaggugauagcucatt

SEQ ID NO: 541 - DNA, 21 bp, Artificial sequence
  Synthetic sequence: Chemically modified dsRNA targeting E6AP; sense strand
  modified_base (6)..(6): um
  modified_base (10)..(10): um
  modified_base (13)..(13): um
  modified_base (16)..(16): cm
  modified_base (17)..(17): um
  modified_base (18)..(18): cm
  misc_feature (20)..(20): t is deoxy-thymidine - 5prime - phosphorothioate
aaggauaggugauagcucatt

SEQ ID NO: 542 - DNA, 21 bp, Artificial sequence
  Synthetic sequence: Chemically modified dsRNA targeting E6AP; sense strand
  modified_base (6)..(6): um
  modified_base (10)..(10): um
  modified_base (13)..(13): um
  modified_base (16)..(16): cm
  modified_base (17)..(17): um
  modified_base (18)..(18): cm
  misc_feature (20)..(20): t is deoxy-thymidine - 5prime - phosphorothioate
aaggauaggugauagcucatt

SEQ ID NO: 543 - DNA, 21 bp, Artificial sequence
  Synthetic sequence: Chemically modified dsRNA targeting E6AP; sense strand
  misc_feature (21)..(21): terminal t linked to a cholesterol derivative
aaggauaggugauagcucatt

SEQ ID NO: 544 - DNA, 21 bp, Artificial sequence
  Synthetic sequence: Chemically modified dsRNA targeting E6AP; sense strand
  modified_base (6)..(6): um
  modified_base (10)..(10): um
  modified_base (13)..(13): um
  modified_base (16)..(16): cm
  modified_base (17)..(17): um
  modified_base (18)..(18): cm
  misc_feature (21)..(21): terminal t linked to a cholesterol derivative
aaggauaggugauagcucatt

SEQ ID NO: 545 - DNA, 21 bp, Artificial sequence
  Synthetic sequence: Chemically modified dsRNA targeting E6AP; sense strand
  modified_base (6)..(6): um
  modified_base (10)..(10): um
  modified_base (13)..(13): um
  modified_base (16)..(16): cm
  modified_base (17)..(17): um
  modified_base (18)..(18): cm
  misc_feature (21)..(21): terminal t linked to a cholesterol derivative
aaggauaggugauagcucatt

SEQ ID NO: 546 - DNA, 21 bp, Artificial sequence
  Synthetic sequence: dsRNA targeting E6AP; sense strand
ggaagccggaaucuagauutt

SEQ ID NO: 547 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
ggaagccggaaucuagauutt

SEQ ID NO: 548 - DNA, 21 bp, Artificial sequence
  Synthetic sequence: Chemically modified dsRNA targeting E6AP; sense strand
  modified_base (6)..(7): cm
  modified_base (12)..(12): um
  modified_base (13)..(13): cm
  modified_base (14)..(14): um
  modified_base (18)..(19): um
  misc_feature (20)..(20): t is deoxy-thymidine - 5prime - phosphorothioate
ggaagccggaaucuagauutt

SEQ ID NO: 549 - DNA, 21 bp, Artificial sequence
  Synthetic sequence: Chemically modified dsRNA targeting E6AP; sense strand
  modified_base (6)..(7): cm
  modified_base (12)..(12): um
  modified_base (13)..(13): cm
  modified_base (14)..(14): um
  modified_base (18)..(19): um
  misc_feature (20)..(20): t is deoxy-thymidine - 5prime - phosphorothioate
ggaagccggaaucuagauutt

SEQ ID NO: 550 - DNA, 21 bp, Artificial sequence
  Synthetic sequence: Chemically modified dsRNA targeting E6AP; sense strand
  misc_feature (21)..(21): terminal t linked to a cholesterol derivative
ggaagccggaaucuagauutt

SEQ ID NO: 551 - DNA, 21 bp, Artificial sequence
  Synthetic sequence: Chemically modified dsRNA targeting E6AP; sense strand
  modified_base (6)..(7): cm
  modified_base (12)..(12): um
  modified_base (13)..(13): cm
  modified_base (14)..(14): um
  modified_base (18)..(19): um
  misc_feature (21)..(21): terminal t linked to a cholesterol derivative
ggaagccggaaucuagauutt

SEQ ID NO: 552 - DNA, 21 bp, Artificial sequence
  Synthetic sequence: Chemically modified dsRNA targeting E6AP; sense strand
  modified_base (6)..(7): cm
  modified_base (12)..(12): um
  modified_base (13)..(13): cm
  modified_base (14)..(14): um
  modified_base (18)..(19): um
  misc_feature (21)..(21): terminal t linked to a cholesterol derivative
ggaagccggaaucuagauutt

SEQ ID NO: 553 - DNA, 21 bp, Artificial sequence
  Synthetic sequence: dsRNA targeting E6AP; sense strand
ugcuucgaagugcuugaaatt

SEQ ID NO: 554 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
ugcuucgaagugcuugaaatt

SEQ ID NO: 555 - DNA, 21 bp, Artificial sequence
  Synthetic sequence: Chemically modified dsRNA targeting E6AP; sense strand
  modified_base (1)..(1): um
  modified_base (3)..(3): cm
  modified_base (4)..(5): um
  modified_base (6)..(6): cm
  modified_base (11)..(11): um
  modified_base (13)..(13): cm
  modified_base (14)..(15): um
  misc_feature (20)..(20): t is deoxy-thymidine - 5prime - phosphorothioate
ugcuucgaagugcuugaaatt

SEQ ID NO: 556 - DNA, 21 bp, Artificial sequence
  Synthetic sequence: Chemically modified dsRNA targeting E6AP; sense strand
  modified_base (1)..(1): um
  modified_base (3)..(3): cm
  modified_base (4)..(5): um
  modified_base (6)..(6): cm
  modified_base (11)..(11): um
  modified_base (13)..(13): cm
  modified_base (14)..(15): um
  misc_feature (20)..(20): t is deoxy-thymidine - 5prime - phosphorothioate
ugcuucgaagugcuugaaatt

SEQ ID NO: 557 - DNA, 21 bp, Artificial sequence
  Synthetic sequence: Chemically modified dsRNA targeting E6AP; sense strand
  misc_feature (21)..(21): terminal t linked to a cholesterol derivative
ugcuucgaagugcuugaaatt

SEQ ID NO: 558 - DNA, 21 bp, Artificial sequence
  Synthetic sequence: Chemically modified dsRNA targeting E6AP; sense strand
  modified_base (1)..(1): um
  modified_base (3)..(3): cm
  modified_base (4)..(5): um
  modified_base (6)..(6): cm
  modified_base (11)..(11): um
  modified_base (13)..(13): cm
  modified_base (14)..(15): um
  misc_feature (21)..(21): terminal t linked to a cholesterol derivative
ugcuucgaagugcuugaaatt

SEQ ID NO: 559 - DNA, 21 bp, Artificial sequence
  Synthetic sequence: Chemically modified dsRNA targeting E6AP; sense strand
  modified_base (1)..(1): um
  modified_base (3)..(3): cm
  modified_base (4)..(5): um
  modified_base (6)..(6): cm
  modified_base (11)..(11): um
  modified_base (13)..(13): cm
  modified_base (14)..(15): um
  misc_feature (21)..(21): terminal t linked to a cholesterol derivative
ugcuucgaagugcuugaaatt

SEQ ID NO: 560 - DNA, 21 bp, Artificial sequence
  Synthetic sequence: dsRNA targeting E6AP; sense strand
uggauugucgaaaaccacutt

SEQ ID NO: 561 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
uggauugucgaaaaccacutt

SEQ ID NO: 562 - DNA, 21 bp, Artificial sequence
  Synthetic sequence: Chemically modified dsRNA targeting E6AP; sense strand
  modified_base (1)..(1): um
  modified_base (5)..(6): um
  modified_base (8)..(8): um
  modified_base (9)..(9): cm
  modified_base (15)..(16): cm
  modified_base (18)..(18): cm
  modified_base (19)..(19): um
  misc_feature (20)..(20): t is deoxy-thymidine - 5prime - phosphorothioate
uggauugucgaaaaccacutt

SEQ ID NO: 563 - DNA, 21 bp, Artificial sequence
  Synthetic sequence: Chemically modified dsRNA targeting E6AP; sense strand
  modified_base (1)..(1): um
  modified_base (5)..(6): um
  modified_base (8)..(8): um
  modified_base (9)..(9): cm
  modified_base (15)..(16): cm
  modified_base (18)..(18): cm
  modified_base (19)..(19): um
  misc_feature (20)..(20): t is deoxy-thymidine - 5prime - phosphorothioate
uggauugucgaaaaccacutt

SEQ ID NO: 564 - DNA, 21 bp, Artificial sequence
  Synthetic sequence: Chemically modified dsRNA targeting E6AP; sense strand
  misc_feature (21)..(21): terminal t linked to a cholesterol derivative
uggauugucgaaaaccacutt

SEQ ID NO: 565 - DNA, 21 bp, Artificial sequence
  Synthetic sequence: Chemically modified dsRNA targeting E6AP; sense strand
  modified_base (1)..(1): um
  modified_base (5)..(6): um
  modified_base (8)..(8): um
  modified_base (9)..(9): cm
  modified_base (15)..(16): cm
  modified_base (18)..(18): cm
  modified_base (19)..(19): um
  misc_feature (21)..(21): terminal t linked to a cholesterol derivative
uggauugucgaaaaccacutt

SEQ ID NO: 566 - DNA, 21 bp, Artificial sequence
  Synthetic sequence: Chemically modified dsRNA targeting E6AP; sense strand
  modified_base (1)..(1): um
  modified_base (5)..(6): um
  modified_base (8)..(8): um
  modified_base (9)..(9): cm
  modified_base (15)..(16): cm
  modified_base (18)..(18): cm
  modified_base (19)..(19): um
  misc_feature (21)..(21): terminal t linked to a cholesterol derivative
uggauugucgaaaaccacutt

SEQ ID NO: 567 - DNA, 21 bp, Artificial sequence
  Synthetic sequence: dsRNA targeting E6AP; sense strand
cggcuagagaugaucgcuatt

SEQ ID NO: 568 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
cggcuagagaugaucgcuatt

SEQ ID NO: 569 - DNA, 21 bp, Artificial sequence
  Synthetic sequence: Chemically modified dsRNA targeting E6AP; sense strand
  modified_base (1)..(1): cm
  modified_base (4)..(4): cm
  modified_base (5)..(5): um
  modified_base (11)..(11): um
  modified_base (14)..(14): um
  modified_base (15)..(15): cm
  modified_base (17)..(17): cm
  modified_base (18)..(18): um
  misc_feature (20)..(20): t is deoxy-thymidine - 5prime - phosphorothioate
cggcuagagaugaucgcuatt

SEQ ID NO: 570 - DNA, 21 bp, Artificial sequence
  Synthetic sequence: Chemically modified dsRNA targeting E6AP; sense strand
  modified_base (1)..(1): cm
  modified_base (4)..(4): cm
  modified_base (5)..(5): um
  modified_base (11)..(11): um
  modified_base (14)..(14): um
  modified_base (15)..(15): cm
  modified_base (17)..(17): cm
  modified_base (18)..(18): um
  misc_feature (20)..(20): t is deoxy-thymidine - 5prime - phosphorothioate
cggcuagagaugaucgcuatt

SEQ ID NO: 571 - DNA, 21 bp, Artificial sequence
  Synthetic sequence: Chemically modified dsRNA targeting E6AP; sense strand
  misc_feature (21)..(21): terminal t linked to a cholesterol derivative
cggcuagagaugaucgcuatt

SEQ ID NO: 572 - DNA, 21 bp, Artificial sequence
  Synthetic sequence: Chemically modified dsRNA targeting E6AP; sense strand
  modified_base (1)..(1): cm
  modified_base (4)..(4): cm
  modified_base (5)..(5): um
  modified_base (11)..(11): um
  modified_base (14)..(14): um
  modified_base (15)..(15): cm
  modified_base (17)..(17): cm
  modified_base (18)..(18): um
  misc_feature (21)..(21): terminal t linked to a cholesterol derivative
cggcuagagaugaucgcuatt

SEQ ID NO: 573 - DNA, 21 bp, Artificial sequence
  Synthetic sequence: Chemically modified dsRNA targeting E6AP; sense strand
  modified_base (1)..(1): cm
  modified_base (4)..(4): cm
  modified_base (5)..(5): um
  modified_base (11)..(11): um
  modified_base (14)..(14): um
  modified_base (15)..(15): cm
  modified_base (17)..(17): cm
  modified_base (18)..(18): um
  misc_feature (21)..(21): terminal t linked to a cholesterol derivative
cggcuagagaugaucgcuatt

SEQ ID NO: 574 - DNA, 21 bp, Artificial sequence
  Synthetic sequence: dsRNA targeting E6AP; sense strand
acagucgaaaucuagugaatt

SEQ ID NO: 575 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
acagucgaaaucuagugaatt

SEQ ID NO: 576 - DNA, 21 bp, Artificial sequence
  Synthetic sequence: Chemically modified dsRNA targeting E6AP; sense strand
  modified_base (2)..(2): cm
  modified_base (5)..(5): um
  modified_base (6)..(6): cm
  modified_base (11)..(11): um
  modified_base (12)..(12): cm
  modified_base (13)..(13): um
  modified_base (16)..(16): um
  misc_feature (20)..(20): t is deoxy-thymidine - 5prime - phosphorothioate
acagucgaaaucuagugaatt

SEQ ID NO: 577 - DNA, 21 bp, Artificial sequence
  Synthetic sequence: Chemically modified dsRNA targeting E6AP; sense strand
  modified_base (2)..(2): cm
  modified_base (5)..(5): um
  modified_base (6)..(6): cm
  modified_base (11)..(11): um
  modified_base (12)..(12): cm
  modified_base (13)..(13): um
  modified_base (16)..(16): um
  misc_feature (20)..(20): t is deoxy-thymidine - 5prime - phosphorothioate
acagucgaaaucuagugaatt

SEQ ID NO: 578 - DNA, 21 bp, Artificial sequence
  Synthetic sequence: Chemically modified dsRNA targeting E6AP; sense strand
  misc_feature (21)..(21): terminal t linked to a cholesterol derivative
acagucgaaaucuagugaatt

SEQ ID NO: 579 - DNA, 21 bp, Artificial sequence
  Synthetic sequence: Chemically modified dsRNA targeting E6AP; sense strand
  modified_base (2)..(2): cm
  modified_base (5)..(5): um
  modified_base (6)..(6): cm
  modified_base (11)..(11): um
  modified_base (12)..(12): cm
  modified_base (13)..(13): um
  modified_base (16)..(16): um
  misc_feature (21)..(21): terminal t linked to a cholesterol derivative
acagucgaaaucuagugaatt

SEQ ID NO: 580 - DNA, 21 bp, Artificial sequence
  Synthetic sequence: Chemically modified dsRNA targeting E6AP; sense strand
  modified_base (2)..(2): cm
  modified_base (5)..(5): um
  modified_base (6)..(6): cm
  modified_base (11)..(11): um
  modified_base (12)..(12): cm
  modified_base (13)..(13): um
  modified_base (16)..(16): um
  misc_feature (21)..(21): terminal t linked to a cholesterol derivative
acagucgaaaucuagugaatt

SEQ ID NO: 581 - DNA, 21 bp, Artificial sequence
  Synthetic sequence: dsRNA targeting E6AP; sense strand
cucgagauccuaauuaucutt

SEQ ID NO: 582 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
cucgagauccuaauuaucutt

SEQ ID NO: 583 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (8)..(8): um
  modified_base (9)..(10): cm
  modified_base (11)..(11): um
  modified_base (14)..(15): um
  modified_base (17)..(17): um
  modified_base (18)..(18): cm
  modified_base (19)..(19): um
  misc_feature (20)..(20): t is deoxy-thymidine - 5prime - phosphorothioate
cucgagauccuaauuaucutt

SEQ ID NO: 584 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (8)..(8): um
  modified_base (9)..(10): cm
  modified_base (11)..(11): um
  modified_base (14)..(15): um
  modified_base (17)..(17): um
  modified_base (19)..(19): um
  modified_base (18)..(18): cm
  misc_feature (20)..(20): t is deoxy-thymidine - 5prime - phosphorothioate
cucgagauccuaauuaucutt

SEQ ID NO: 585 - DNA, 21 bp, Artificial sequence
  Synthetic sequence: Chemically modified dsRNA targeting E6AP; sense strand
  misc_feature (21)..(21): terminal t linked to a cholesterol derivative
cucgagauccuaauuaucutt

SEQ ID NO: 586 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (8)..(8): um
  modified_base (9)..(10): cm
  modified_base (11)..(11): um
  modified_base (14)..(15): um
  modified_base (17)..(17): um
  modified_base (18)..(18): cm
  modified_base (19)..(19): um
  misc_feature (21)..(21): terminal t linked to a cholesterol derivative
cucgagauccuaauuaucutt

SEQ ID NO: 587 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (8)..(8): um
  modified_base (9)..(10): cm
  modified_base (11)..(11): um
  modified_base (14)..(15): um
  modified_base (17)..(17): um
  modified_base (18)..(18): cm
  modified_base (19)..(19): um
  misc_feature (21)..(21): terminal t linked to a cholesterol derivative
cucgagauccuaauuaucutt

SEQ ID NO: 588 - DNA, 21 bp, Artificial sequence
  Synthetic sequence: dsRNA targeting E6AP; sense strand
caccuaacguggaaugugatt

SEQ ID NO: 589 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
caccuaacguggaaugugatt

SEQ ID NO: 590 - DNA, 21 bp, Artificial sequence
  Synthetic sequence: Chemically modified dsRNA targeting E6AP; sense strand
  modified_base (1)..(1): cm
  modified_base (3)..(4): cm
  modified_base (5)..(5): um
  modified_base (8)..(8): cm
  modified_base (10)..(10): um
  modified_base (15)..(15): um
  modified_base (17)..(17): um
  misc_feature (20)..(20): t is deoxy-thymidine - 5prime - phosphorothioate
caccuaacguggaaugugatt

SEQ ID NO: 591 - DNA, 21 bp, Artificial sequence
  Synthetic sequence: Chemically modified dsRNA targeting E6AP; sense strand
  modified_base (1)..(1): cm
  modified_base (3)..(4): cm
  modified_base (5)..(5): um
  modified_base (8)..(8): cm
  modified_base (10)..(10): um
  modified_base (15)..(15): um
  modified_base (17)..(17): um
  misc_feature (20)..(20): t is deoxy-thymidine - 5prime - phosphorothioate
caccuaacguggaaugugatt

SEQ ID NO: 592 - DNA, 21 bp, Artificial sequence
  Synthetic sequence: Chemically modified dsRNA targeting E6AP; sense strand
  misc_feature (21)..(21): terminal t linked to a cholesterol derivative
caccuaacguggaaugugatt

SEQ ID NO: 593 - DNA, 21 bp, Artificial sequence
  Synthetic sequence: Chemically modified dsRNA targeting E6AP; sense strand
  modified_base (1)..(1): cm
  modified_base (3)..(4): cm
  modified_base (5)..(5): um
  modified_base (8)..(8): cm
  modified_base (10)..(10): um
  modified_base (15)..(15): um
  modified_base (17)..(17): um
  misc_feature (21)..(21): terminal t linked to a cholesterol derivative
caccuaacguggaaugugatt

SEQ ID NO: 594 - DNA, 21 bp, Artificial sequence
  Synthetic sequence: Chemically modified dsRNA targeting E6AP; sense strand
  modified_base (1)..(1): cm
  modified_base (3)..(4): cm
  modified_base (5)..(5): um
  modified_base (8)..(8): cm
  modified_base (10)..(10): um
  modified_base (15)..(15): um
  modified_base (17)..(17): um
  misc_feature (21)..(21): terminal t linked to a cholesterol derivative
caccuaacguggaaugugatt

SEQ ID NO: 595 - DNA, 21 bp, Artificial sequence
  Synthetic sequence: dsRNA targeting E6AP; sense strand
aaucguucauucauuuacatt

SEQ ID NO: 596 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
aaucguucauucauuuacatt

SEQ ID NO: 597 - DNA, 21 bp, Artificial sequence
  Synthetic sequence: Chemically modified dsRNA targeting E6AP; sense strand
  modified_base (3)..(3): um
  modified_base (4)..(4): cm
  modified_base (6)..(7): um
  modified_base (8)..(8): cm
  modified_base (10)..(11): um
  modified_base (12)..(12): cm
  modified_base (14)..(16): um
  modified_base (18)..(18): cm
  misc_feature (20)..(20): t is deoxy-thymidine - 5prime - phosphorothioate
aaucguucauucauuuacatt

SEQ ID NO: 598 - DNA, 21 bp, Artificial sequence
  Synthetic sequence: Chemically modified dsRNA targeting E6AP; sense strand
  modified_base (3)..(3): um
  modified_base (4)..(4): cm
  modified_base (6)..(7): um
  modified_base (8)..(8): cm
  modified_base (10)..(11): um
  modified_base (12)..(12): cm
  modified_base (14)..(16): um
  modified_base (18)..(18): cm
  misc_feature (20)..(20): t is deoxy-thymidine - 5prime - phosphorothioate
aaucguucauucauuuacatt

SEQ ID NO: 599 - DNA, 21 bp, Artificial sequence
  Synthetic sequence: Chemically modified dsRNA targeting E6AP; sense strand
  misc_feature (21)..(21): terminal t linked to a cholesterol derivative
aaucguucauucauuuacatt

SEQ ID NO: 600 - DNA, 21 bp, Artificial sequence
  Synthetic sequence: Chemically modified dsRNA targeting E6AP; sense strand
  modified_base (3)..(3): um
  modified_base (4)..(4): cm
  modified_base (6)..(7): um
  modified_base (8)..(8): cm
  modified_base (10)..(11): um
  modified_base (12)..(12): cm
  modified_base (14)..(16): um
  modified_base (18)..(18): cm
  misc_feature (21)..(21): terminal t linked to a cholesterol derivative
aaucguucauucauuuacatt

SEQ ID NO: 601 - DNA, 21 bp, Artificial sequence
  Synthetic sequence: Chemically modified dsRNA targeting E6AP; sense strand
  modified_base (3)..(3): um
  modified_base (4)..(4): cm
  modified_base (6)..(7): um
  modified_base (8)..(8): cm
  modified_base (10)..(11): um
  modified_base (12)..(12): cm
  modified_base (14)..(16): um
  modified_base (18)..(18): cm
  misc_feature (21)..(21): terminal t linked to a cholesterol derivative
aaucguucauucauuuacatt

SEQ ID NO: 602 - DNA, 21 bp, Artificial sequence
  Synthetic sequence: dsRNA targeting E6AP; sense strand
aacuuuucgugacuugggatt

SEQ ID NO: 603 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
aacuuuucgugacuugggatt

SEQ ID NO: 604 - DNA, 21 bp, Artificial sequence
  Synthetic sequence: Chemically modified dsRNA targeting E6AP; sense strand
  modified_base (3)..(3): cm
  modified_base (4)..(7): um
  modified_base (8)..(8): cm
  modified_base (10)..(10): um
  modified_base (13)..(13): cm
  modified_base (14)..(15): um
  misc_feature (20)..(20): t is deoxy-thymidine - 5prime - phosphorothioate
aacuuuucgugacuugggatt

SEQ ID NO: 605 - DNA, 21 bp, Artificial sequence
  Synthetic sequence: Chemically modified dsRNA targeting E6AP; sense strand
  modified_base (3)..(3): cm
  modified_base (4)..(7): um
  modified_base (8)..(8): cm
  modified_base (10)..(10): um
  modified_base (13)..(13): cm
  modified_base (14)..(15): um
  misc_feature (20)..(20): t is deoxy-thymidine - 5prime - phosphorothioate
aacuuuucgugacuugggatt

SEQ ID NO: 606 - DNA, 21 bp, Artificial sequence
  Synthetic sequence: Chemically modified dsRNA targeting E6AP; sense strand
  misc_feature (21)..(21): terminal t linked to a cholesterol derivative
aacuuuucgugacuugggatt

SEQ ID NO: 607 - DNA, 21 bp, Artificial sequence
  Synthetic sequence: Chemically modified dsRNA targeting E6AP; sense strand
  modified_base (3)..(3): cm
  modified_base (4)..(7): um
  modified_base (8)..(8): cm
  modified_base (10)..(10): um
  modified_base (13)..(13): cm
  modified_base (14)..(15): um
  misc_feature (21)..(21): terminal t linked to a cholesterol derivative
aacuuuucgugacuugggatt

SEQ ID NO: 608 - DNA, 21 bp, Artificial sequence
  Synthetic sequence: Chemically modified dsRNA targeting E6AP; sense strand
  modified_base (3)..(3): cm
  modified_base (4)..(7): um
  modified_base (8)..(8): cm
  modified_base (10)..(10): um
  modified_base (13)..(13): cm
  modified_base (14)..(15): um
  misc_feature (21)..(21): terminal t linked to a cholesterol derivative
aacuuuucgugacuugggatt

SEQ ID NO: 609 - DNA, 21 bp, Artificial sequence
  Synthetic sequence: dsRNA targeting E6AP; sense strand
aacagucgaaaucuagugatt

SEQ ID NO: 610 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
aacagucgaaaucuagugatt

SEQ ID NO: 611 - DNA, 21 bp, Artificial sequence
  Synthetic sequence: Chemically modified dsRNA targeting E6AP; sense strand
  modified_base (3)..(3): cm
  modified_base (6)..(6): um
  modified_base (7)..(7): cm
  modified_base (12)..(12): um
  modified_base (13)..(13): cm
  modified_base (14)..(14): um
  modified_base (17)..(17): um
  misc_feature (20)..(20): t is deoxy-thymidine - 5prime - phosphorothioate
aacagucgaaaucuagugatt

SEQ ID NO: 612 - DNA, 21 bp, Artificial sequence
  Synthetic sequence: Chemically modified dsRNA targeting E6AP; sense strand
  modified_base (3)..(3): cm
  modified_base (6)..(6): um
  modified_base (7)..(7): cm
  modified_base (12)..(12): um
  modified_base (13)..(13): cm
  modified_base (14)..(14): um
  modified_base (17)..(17): um
  misc_feature (20)..(20): t is deoxy-thymidine - 5prime - phosphorothioate
aacagucgaaaucuagugatt

SEQ ID NO: 613 - DNA, 21 bp, Artificial sequence
  Synthetic sequence: Chemically modified dsRNA targeting E6AP; sense strand
  misc_feature (21)..(21): terminal t linked to a cholesterol derivative
aacagucgaaaucuagugatt

SEQ ID NO: 614 - DNA, 21 bp, Artificial sequence
  Synthetic sequence: Chemically modified dsRNA targeting E6AP; sense strand
  modified_base (3)..(3): cm
  modified_base (6)..(6): um
  modified_base (7)..(7): cm
  modified_base (12)..(12): um
  modified_base (13)..(13): cm
  modified_base (14)..(14): um
  modified_base (17)..(17): um
  misc_feature (21)..(21): terminal t linked to a cholesterol derivative
aacagucgaaaucuagugatt

SEQ ID NO: 615 - DNA, 21 bp, Artificial sequence
  Synthetic sequence: Chemically modified dsRNA targeting E6AP; sense strand
  modified_base (3)..(3): cm
  modified_base (6)..(6): um
  modified_base (7)..(7): cm
  modified_base (12)..(12): um
  modified_base (13)..(13): cm
  modified_base (14)..(14): um
  modified_base (17)..(17): um
  misc_feature (21)..(21): terminal t linked to a cholesterol derivative
aacagucgaaaucuagugatt

SEQ ID NO: 616 - DNA, 21 bp, Artificial sequence
  Synthetic sequence: dsRNA targeting E6AP; sense strand
acgaaugaguuuugugcuutt

SEQ ID NO: 617 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
acgaaugaguuuugugcuutt

SEQ ID NO: 618 - DNA, 21 bp, Artificial sequence
  Synthetic sequence: Chemically modified dsRNA targeting E6AP; sense strand
  modified_base (2)..(2): cm
  modified_base (6)..(6): um
  modified_base (10)..(13): um
  modified_base (15)..(15): um
  modified_base (17)..(17): cm
  modified_base (18)..(19): um
  misc_feature (20)..(20): t is deoxy-thymidine - 5prime - phosphorothioate
acgaaugaguuuugugcuutt

SEQ ID NO: 619 - DNA, 21 bp, Artificial sequence
  Synthetic sequence: Chemically modified dsRNA targeting E6AP; sense strand
  modified_base (2)..(2): cm
  modified_base (6)..(6): um
  modified_base (10)..(13): um
  modified_base (15)..(15): um
  modified_base (17)..(17): cm
  modified_base (18)..(19): um
  misc_feature (20)..(20): t is deoxy-thymidine - 5prime - phosphorothioate
acgaaugaguuuugugcuutt

SEQ ID NO: 620 - DNA, 21 bp, Artificial sequence
  Synthetic sequence: Chemically modified dsRNA targeting E6AP; sense strand
  misc_feature (21)..(21): terminal t linked to a cholesterol derivative
acgaaugaguuuugugcuutt

SEQ ID NO: 621 - DNA, 21 bp, Artificial sequence
  Synthetic sequence: Chemically modified dsRNA targeting E6AP; sense strand
  modified_base (2)..(2): cm
  modified_base (6)..(6): um
  modified_base (10)..(13): um
  modified_base (15)..(15): um
  modified_base (17)..(17): cm
  modified_base (18)..(19): um
  misc_feature (21)..(21): terminal t linked to a cholesterol derivative
acgaaugaguuuugugcuutt

SEQ ID NO: 622 - DNA, 21 bp, Artificial sequence
  Synthetic sequence: Chemically modified dsRNA targeting E6AP; sense strand
  modified_base (2)..(2): cm
  modified_base (6)..(6): um
  modified_base (10)..(13): um
  modified_base (15)..(15): um
  modified_base (17)..(17): cm
  modified_base (18)..(19): um
  misc_feature (21)..(21): terminal t linked to a cholesterol derivative
acgaaugaguuuugugcuutt

SEQ ID NO: 623 - DNA, 21 bp, Artificial sequence
  Synthetic sequence: dsRNA targeting E6AP; sense strand
aauucgcauguacagugaatt

SEQ ID NO: 624 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
aauucgcauguacagugaatt

SEQ ID NO: 625 - DNA, 21 bp, Artificial sequence
  Synthetic sequence: Chemically modified dsRNA targeting E6AP; sense strand
  modified_base (3)..(4): um
  modified_base (5)..(5): cm
  modified_base (7)..(7): cm
  modified_base (9)..(9): um
  modified_base (11)..(11): um
  modified_base (13)..(13): cm
  modified_base (16)..(16): um
  misc_feature (20)..(20): t is deoxy-thymidine - 5prime - phosphorothioate
aauucgcauguacagugaatt

SEQ ID NO: 626 - DNA, 21 bp, Artificial sequence
  Synthetic sequence: Chemically modified dsRNA targeting E6AP; sense strand
  modified_base (3)..(4): um
  modified_base (5)..(5): cm
  modified_base (7)..(7): cm
  modified_base (9)..(9): um
  modified_base (11)..(11): um
  modified_base (13)..(13): cm
  modified_base (16)..(16): um
  misc_feature (20)..(20): t is deoxy-thymidine - 5prime - phosphorothioate
aauucgcauguacagugaatt

SEQ ID NO: 627 - DNA, 21 bp, Artificial sequence
  Synthetic sequence: Chemically modified dsRNA targeting E6AP; sense strand
  misc_feature (21)..(21): terminal t linked to a cholesterol derivative
aauucgcauguacagugaatt

SEQ ID NO: 628 - DNA, 21 bp, Artificial sequence
  Synthetic sequence: Chemically modified dsRNA targeting E6AP; sense strand
  modified_base (3)..(4): um
  modified_base (5)..(5): cm
  modified_base (7)..(7): cm
  modified_base (9)..(9): um
  modified_base (11)..(11): um
  modified_base (13)..(13): cm
  modified_base (16)..(16): um
  misc_feature (21)..(21): terminal t linked to a cholesterol derivative
aauucgcauguacagugaatt

SEQ ID NO: 629 - DNA, 21 bp, Artificial sequence
  Synthetic sequence: Chemically modified dsRNA targeting E6AP; sense strand
  modified_base (3)..(4): um
  modified_base (5)..(5): cm
  modified_base (7)..(7): cm
  modified_base (9)..(9): um
  modified_base (11)..(11): um
  modified_base (13)..(13): cm
  modified_base (16)..(16): um
  misc_feature (21)..(21): terminal t linked to a cholesterol derivative
aauucgcauguacagugaatt

SEQ ID NO: 630 - DNA, 21 bp, Artificial sequence
  Synthetic sequence: dsRNA targeting E6AP; sense strand
aauagaauucgcauguacatt

SEQ ID NO: 631 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
aauagaauucgcauguacatt

SEQ ID NO: 632 - DNA, 21 bp, Artificial sequence
  Synthetic sequence: Chemically modified dsRNA targeting E6AP; sense strand
  modified_base (3)..(3): um
  modified_base (8)..(9): um
  modified_base (10)..(10): cm
  modified_base (12)..(12): cm
  modified_base (14)..(14): um
  modified_base (16)..(16): um
  modified_base (18)..(18): cm
  misc_feature (20)..(20): t is deoxy-thymidine - 5prime - phosphorothioate
aauagaauucgcauguacatt

SEQ ID NO: 633 - DNA, 21 bp, Artificial sequence
  Synthetic sequence: Chemically modified dsRNA targeting E6AP; sense strand
  modified_base (3)..(3): um
  modified_base (8)..(9): um
  modified_base (10)..(10): cm
  modified_base (12)..(12): cm
  modified_base (14)..(14): um
  modified_base (16)..(16): um
  modified_base (18)..(18): cm
  misc_feature (20)..(20): t is deoxy-thymidine - 5prime - phosphorothioate
aauagaauucgcauguacatt

SEQ ID NO: 634 - DNA, 21 bp, Artificial sequence
  Synthetic sequence: Chemically modified dsRNA targeting E6AP; sense strand
  misc_feature (21)..(21): terminal t linked to a cholesterol derivative
aauagaauucgcauguacatt

SEQ ID NO: 635 - DNA, 21 bp, Artificial sequence
  Synthetic sequence: Chemically modified dsRNA targeting E6AP; sense strand
  modified_base (3)..(3): um
  modified_base (8)..(9): um
  modified_base (10)..(10): cm
  modified_base (12)..(12): cm
  modified_base (14)..(14): um
  modified_base (16)..(16): um
  modified_base (18)..(18): cm
  misc_feature (21)..(21): terminal t linked to a cholesterol derivative
aauagaauucgcauguacatt

SEQ ID NO: 636 - DNA, 21 bp, Artificial sequence
  Synthetic sequence: Chemically modified dsRNA targeting E6AP; sense strand
  modified_base (3)..(3): um
  modified_base (8)..(9): um
  modified_base (10)..(10): cm
  modified_base (12)..(12): cm
  modified_base (14)..(14): um
  modified_base (16)..(16): um
  modified_base (18)..(18): cm
  misc_feature (21)..(21): terminal t linked to a cholesterol derivative
aauagaauucgcauguacatt

SEQ ID NO: 637 - DNA, 21 bp, Artificial sequence
  Synthetic sequence: dsRNA targeting E6AP; sense strand
ugguaacccaaugauguautt

SEQ ID NO: 638 - DNA, 21 bp, Artificial sequence
  Synthetic sequence: Chemically modified dsRNA targeting E6AP; sense strand
  misc_feature (20)..(20): t is deoxy-thymidine - 5prime - phosphorothioate
ugguaacccaaugauguautt

SEQ ID NO: 639 - DNA, 21 bp, Artificial sequence
  Synthetic sequence: Chemically modified dsRNA targeting E6AP; sense strand
  modified_base (1)..(1): um
  modified_base (4)..(4): um
  modified_base (7)..(9): cm
  modified_base (12)..(12): um
  modified_base (15)..(15): um
  modified_base (17)..(17): um
  modified_base (19)..(19): um
  misc_feature (20)..(20): t is deoxy-thymidine - 5prime - phosphorothioate
ugguaacccaaugauguautt

SEQ ID NO: 640 - DNA, 21 bp, Artificial sequence
  Synthetic sequence: Chemically modified dsRNA targeting E6AP; sense strand
  modified_base (1)..(1): um
  modified_base (4)..(4): um
  modified_base (7)..(9): cm
  modified_base (12)..(12): um
  modified_base (15)..(15): um
  modified_base (17)..(17): um
  modified_base (19)..(19): um
  misc_feature (20)..(20): t is deoxy-thymidine - 5prime - phosphorothioate
ugguaacccaaugauguautt

SEQ ID NO: 641 - DNA, 21 bp, Artificial sequence
  Synthetic sequence: Chemically modified dsRNA targeting E6AP; sense strand
  misc_feature (21)..(21): terminal t linked to a cholesterol derivative
ugguaacccaaugauguautt

SEQ ID NO: 642 - DNA, 21 bp, Artificial sequence
  Synthetic sequence: Chemically modified dsRNA targeting E6AP; sense strand
  modified_base (1)..(1): um
  modified_base (4)..(4): um
  modified_base (7)..(9): cm
  modified_base (12)..(12): um
  modified_base (15)..(15): um
  modified_base (17)..(17): um
  modified_base (19)..(19): um
  misc_feature (21)..(21): terminal t linked to a cholesterol derivative
ugguaacccaaugauguautt

SEQ ID NO: 643 - DNA, 21 bp, Artificial sequence
  Synthetic sequence: Chemically modified dsRNA targeting E6AP; sense strand
  modified_base (1)..(1): um
  modified_base (4)..(4): um
  modified_base (7)..(9): cm
  modified_base (12)..(12): um
  modified_base (15)..(15): um
  modified_base (17)..(17): um
  modified_base (19)..(19): um
  misc_feature (21)..(21): terminal t linked to a cholesterol derivative
ugguaacccaaugauguautt

SEQ ID NO: 644 - DNA, 21 bp, Artificial sequence
  Synthetic sequence: dsRNA targeting E6AP; antisense strand
uuuuguagauucaucguautt

SEQ ID NO: 645 - DNA, 21 bp, Artificial sequence
  Synthetic sequence: Chemically modified dsRNA targeting E6AP; antisense strand
  misc_feature 20: t is deoxy-thymidine-5prime-phosphorothioate
uuuuguagauucaucguautt

SEQ ID NO: 646 - DNA, 21 bp, Artificial sequence
  Synthetic sequence: Chemically modified dsRNA targeting E6AP; antisense strand
  modified_base (6)..(6): um
  modified_base (12)..(12): cm
  modified_base (17)..(17): um
  misc_feature 20: t is deoxy-thymidine-5prime-phosphorothioate
uuuuguagauucaucguautt

SEQ ID NO: 647 - DNA, 21 bp, Artificial sequence
  Synthetic sequence: Chemically modified dsRNA targeting E6AP; antisense strand
  modified_base (1)..(4): um
  modified_base (6)..(6): um
  modified_base (10)..(10): um
  modified_base (12)..(12): cm
  modified_base (17)..(17): um
  misc_feature 20: t is deoxy-thymidine-5prime-phosphorothioate
uuuuguagauucaucguautt

SEQ ID NO: 648 - DNA, 21 bp, Artificial sequence
  Synthetic sequence: Chemically modified dsRNA targeting E6AP; antisense strand
  misc_feature 20: t is deoxy-thymidine-5prime-phosphorothioate
uuuuguagauucaucguautt

SEQ ID NO: 649 - DNA, 21 bp, Artificial sequence
  Synthetic sequence: Chemically modified dsRNA targeting E6AP; antisense strand
  modified_base (6)..(6): um
  modified_base (12)..(12): cm
  modified_base (17)..(17): um
  misc_feature 20: t is deoxy-thymidine-5prime-phosphorothioate
uuuuguagauucaucguautt

SEQ ID NO: 650 - DNA, 21 bp, Artificial sequence
  Synthetic sequence: Chemically modified dsRNA targeting E6AP; antisense strand
  modified_base (1)..(4): um
  modified_base (6)..(6): um
  modified_base (10)..(10): um
  modified_base (12)..(12): cm
  modified_base (17)..(17): um
  misc_feature 20: t is deoxy-thymidine-5prime-phosphorothioate
uuuuguagauucaucguautt

SEQ ID NO: 651 - DNA, 21 bp, Artificial sequence
  Synthetic sequence: dsRNA targeting E6AP; antisense strand
uuuauugagaauguagucatt

SEQ ID NO: 652 - DNA, 21 bp, Artificial sequence
  Synthetic sequence: Chemically modified dsRNA targeting E6AP; antisense strand
  misc_feature 20: t is deoxy-thymidine-5prime-phosphorothioate
uuuauugagaauguagucatt

SEQ ID NO: 653 - DNA, 21 bp, Artificial sequence
  Synthetic sequence: Chemically modified dsRNA targeting E6AP; antisense strand
  modified_base (3)..(3): um
  modified_base (14)..(14): um
  modified_base (18)..(18): cm
  misc_feature 20: t is deoxy-thymidine-5prime-phosphorothioate
uuuauugagaauguagucatt

SEQ ID NO: 654 - DNA, 21 bp, Artificial sequence
  Synthetic sequence: Chemically modified dsRNA targeting E6AP; antisense strand
  modified_base (1)..(3): um
  modified_base (5)..(6): um
  modified_base (12)..(12): um
  modified_base (14)..(14): um
  modified_base (18)..(18): cm
  misc_feature 20: t is deoxy-thymidine-5prime-phosphorothioate
uuuauugagaauguagucatt

SEQ ID NO: 655 - DNA, 21 bp, Artificial sequence
  Synthetic sequence: Chemically modified dsRNA targeting E6AP; antisense strand
  misc_feature 20: t is deoxy-thymidine-5prime-phosphorothioate
uuuauugagaauguagucatt

SEQ ID NO: 656 - DNA, 21 bp, Artificial sequence
  Synthetic sequence: Chemically modified dsRNA targeting E6AP; antisense strand
  modified_base (3)..(3): um
  modified_base (14)..(14): um
  modified_base (18)..(18): cm
  misc_feature 20: t is deoxy-thymidine-5prime-phosphorothioate
uuuauugagaauguagucatt

SEQ ID NO: 657 - DNA, 21 bp, Artificial sequence
  Synthetic sequence: Chemically modified dsRNA targeting E6AP; antisense strand
  modified_base (1)..(3): um
  modified_base (5)..(6): um
  modified_base (12)..(12): um
  modified_base (14)..(14): um
  modified_base (18)..(18): cm
  misc_feature 20: t is deoxy-thymidine-5prime-phosphorothioate
uuuauugagaauguagucatt

SEQ ID NO: 658 - DNA, 21 bp, Artificial sequence
  Synthetic sequence: dsRNA targeting E6AP; antisense strand
aaacucauucgugcaggcutt

SEQ ID NO: 659 - DNA, 21 bp, Artificial sequence
  Synthetic sequence: Chemically modified dsRNA targeting E6AP; antisense strand
  misc_feature 20: t is deoxy-thymidine-5prime-phosphorothioate
aaacucauucgugcaggcutt

SEQ ID NO: 660 - DNA, 21 bp, Artificial sequence
  Synthetic sequence: Chemically modified dsRNA targeting E6AP; antisense strand
  modified_base (6)..(6): cm
  modified_base (14)..(14): cm
  misc_feature 20: t is deoxy-thymidine-5prime-phosphorothioate
aaacucauucgugcaggcutt

SEQ ID NO: 661 - DNA, 21 bp, Artificial sequence
  Synthetic sequence: Chemically modified dsRNA targeting E6AP; antisense strand
  modified_base (6)..(6): cm
  modified_base (8)..(8): um
  modified_base (12)..(12): um
  modified_base (14)..(14): cm
  misc_feature 20: t is deoxy-thymidine-5prime-phosphorothioate
aaacucauucgugcaggcutt

SEQ ID NO: 662 - DNA, 21 bp, Artificial sequence
  Synthetic sequence: Chemically modified dsRNA targeting E6AP; antisense strand
  misc_feature 20: t is deoxy-thymidine-5prime-phosphorothioate
aaacucauucgugcaggcutt

SEQ ID NO: 663 - DNA, 21 bp, Artificial sequence
  Synthetic sequence: Chemically modified dsRNA targeting E6AP; antisense strand
  modified_base (6)..(6): cm
  modified_base (14)..(14): cm
  misc_feature 20: t is deoxy-thymidine-5prime-phosphorothioate
aaacucauucgugcaggcutt

SEQ ID NO: 664 - DNA, 21 bp, Artificial sequence
  Synthetic sequence: Chemically modified dsRNA targeting E6AP; antisense strand
  modified_base (6)..(6): cm
  modified_base (8)..(8): um
  modified_base (12)..(12): um
  modified_base (14)..(14): cm
  misc_feature 20: t is deoxy-thymidine-5prime-phosphorothioate
aaacucauucgugcaggcutt

SEQ ID NO: 665 - DNA, 21 bp, Artificial sequence
  Synthetic sequence: dsRNA targeting E6AP; antisense strand
aagugguuuucgacaaucctt

SEQ ID NO: 666 - DNA, 21 bp, Artificial sequence
  Synthetic sequence: Chemically modified dsRNA targeting E6AP; antisense strand
  misc_feature 20: t is deoxy-thymidine-5prime-phosphorothioate
aagugguuuucgacaaucctt

SEQ ID NO: 667 - DNA, 21 bp, Artificial sequence
  Synthetic sequence: Chemically modified dsRNA targeting E6AP; antisense strand
  modified_base (14)..(14): cm
  misc_feature 20: t is deoxy-thymidine-5prime-phosphorothioate
aagugguuuucgacaaucctt

SEQ ID NO: 668 - DNA, 21 bp, Artificial sequence
  Synthetic sequence: Chemically modified dsRNA targeting E6AP; antisense strand
  modified_base (4)..(4): um
  modified_base (7)..(7): um
  modified_base (9)..(9): um
  modified_base (14)..(14): cm
  misc_feature 20: t is deoxy-thymidine-5prime-phosphorothioate
aagugguuuucgacaaucctt

SEQ ID NO: 669 - DNA, 21 bp, Artificial sequence
  Synthetic sequence: Chemically modified dsRNA targeting E6AP; antisense strand
  misc_feature 20: t is deoxy-thymidine-5prime-phosphorothioate
aagugguuuucgacaaucctt

SEQ ID NO: 670 - DNA, 21 bp, Artificial sequence
  Synthetic sequence: Chemically modified dsRNA targeting E6AP; antisense strand
  modified_base (14)..(14): cm
  misc_feature 20: t is deoxy-thymidine-5prime-phosphorothioate
aagugguuuucgacaaucctt

SEQ ID NO: 671 - DNA, 21 bp, Artificial sequence
  Synthetic sequence: Chemically modified dsRNA targeting E6AP; antisense strand
  modified_base (4)..(4): um
  modified_base (7)..(7): um
  modified_base (9)..(9): um
  modified_base (14)..(14): cm
  misc_feature 20: t is deoxy-thymidine-5prime-phosphorothioate
aagugguuuucgacaaucctt

SEQ ID NO: 672 - DNA, 21 bp, Artificial sequence
  Synthetic sequence: dsRNA targeting E6AP; antisense strand
auaauuaggaucucgagagtt

SEQ ID NO: 673 - DNA, 21 bp, Artificial sequence
  Synthetic sequence: Chemically modified dsRNA targeting E6AP; antisense strand
  misc_feature 20: t is deoxy-thymidine-5prime-phosphorothioate
auaauuaggaucucgagagtt

SEQ ID NO: 674 - DNA, 21 bp, Artificial sequence
  Synthetic sequence: Chemically modified dsRNA targeting E6AP; antisense strand
  modified_base (2)..(2): um
  modified_base (6)..(6): um
  misc_feature 20: t is deoxy-thymidine-5prime-phosphorothioate
auaauuaggaucucgagagtt

SEQ ID NO: 675 - DNA, 21 bp, Artificial sequence
  Synthetic sequence: Chemically modified dsRNA targeting E6AP; antisense strand
  modified_base (2)..(2): um
  modified_base (5)..(5): um
  misc_feature 20: t is deoxy-thymidine-5prime-phosphorothioate
auaauuaggaucucgagagtt

SEQ ID NO: 676 - DNA, 21 bp, Artificial sequence
  Synthetic sequence: Chemically modified dsRNA targeting E6AP; antisense strand
  misc_feature 20: t is deoxy-thymidine-5prime-phosphorothioate
auaauuaggaucucgagagtt

SEQ ID NO: 677 - DNA, 21 bp, Artificial sequence
  Synthetic sequence: Chemically modified dsRNA targeting E6AP; antisense strand
  modified_base (2)..(2): um
  modified_base (6)..(6): um
  misc_feature 20: t is deoxy-thymidine-5prime-phosphorothioate
auaauuaggaucucgagagtt

SEQ ID NO: 678 - DNA, 21 bp, Artificial sequence
  Synthetic sequence: Chemically modified dsRNA targeting E6AP; antisense strand
  modified_base (2)..(2): um
  modified_base (5)..(5): um
  misc_feature 20: t is deoxy-thymidine-5prime-phosphorothioate
auaauuaggaucucgagagtt

SEQ ID NO: 679 - DNA, 21 bp, Artificial sequence
  Synthetic sequence: dsRNA targeting E6AP; antisense strand
ucuguuaaguaagucacautt

SEQ ID NO: 680 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucuguuaaguaagucacautt

SEQ ID NO: 681 - DNA, 21 bp, Artificial sequence
  Synthetic sequence: Chemically modified dsRNA targeting E6AP; antisense strand
  modified_base (6)..(6): um
  modified_base (10)..(10): um
  modified_base (15)..(15): cm
  modified_base (17)..(17): cm
  misc_feature 20: t is deoxy-thymidine-5prime-phosphorothioate
ucuguuaaguaagucacautt

SEQ ID NO: 682 - DNA, 21 bp, Artificial sequence
  Synthetic sequence: Chemically modified dsRNA targeting E6AP; antisense strand
  modified_base (3)..(3): um
  modified_base (5)..(6): um
  modified_base (10)..(10): um
  modified_base (15)..(15): cm
  modified_base (17)..(17): cm
  misc_feature 20: t is deoxy-thymidine-5prime-phosphorothioate
ucuguuaaguaagucacautt

SEQ ID NO: 683 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucuguuaaguaagucacautt

SEQ ID NO: 684 - DNA, 21 bp, Artificial sequence
  Synthetic sequence: Chemically modified dsRNA targeting E6AP; antisense strand
  modified_base (6)..(6): um
  modified_base (10)..(10): um
  modified_base (15)..(15): cm
  modified_base (17)..(17): cm
  misc_feature 20: t is deoxy-thymidine-5prime-phosphorothioate
ucuguuaaguaagucacautt

SEQ ID NO: 685 - DNA, 21 bp, Artificial sequence
  Synthetic sequence: Chemically modified dsRNA targeting E6AP; antisense strand
  modified_base (3)..(3): um
  modified_base (5)..(6): um
  modified_base (10)..(10): um
  modified_base (15)..(15): cm
  modified_base (17)..(17): cm
  misc_feature 20: t is deoxy-thymidine-5prime-phosphorothioate
ucuguuaaguaagucacautt

SEQ ID NO: 686 - DNA, 21 bp, Artificial sequence
  Synthetic sequence: dsRNA targeting E6AP; antisense strand
uaggaucucgagaguauactt

SEQ ID NO: 687 - DNA, 21 bp, Artificial sequence
  Synthetic sequence: Chemically modified dsRNA targeting E6AP; antisense strand
  misc_feature 20: t is deoxy-thymidine-5prime-phosphorothioate
uaggaucucgagaguauactt

SEQ ID NO: 688 - DNA, 21 bp, Artificial sequence
  Synthetic sequence: Chemically modified dsRNA targeting E6AP; antisense strand
  modified_base (1)..(1): um
  modified_base (15)..(15): um
  modified_base (17)..(17): um
  misc_feature 20: t is deoxy-thymidine-5prime-phosphorothioate
uaggaucucgagaguauactt

SEQ ID NO: 689 - DNA, 21 bp, Artificial sequence
  Synthetic sequence: Chemically modified dsRNA targeting E6AP; antisense strand
  modified_base (1)..(1): um
  modified_base (15)..(15): um
  modified_base (17)..(17): um
  misc_feature 20: t is deoxy-thymidine-5prime-phosphorothioate
uaggaucucgagaguauactt

SEQ ID NO: 690 - DNA, 21 bp, Artificial sequence
  Synthetic sequence: Chemically modified dsRNA targeting E6AP; antisense strand
  misc_feature 20: t is deoxy-thymidine-5prime-phosphorothioate
uaggaucucgagaguauactt

SEQ ID NO: 691 - DNA, 21 bp, Artificial sequence
  Synthetic sequence: Chemically modified dsRNA targeting E6AP; antisense strand
  modified_base (1)..(1): um
  modified_base (15)..(15): um
  modified_base (17)..(17): um
  misc_feature 20: t is deoxy-thymidine-5prime-phosphorothioate
uaggaucucgagaguauactt

SEQ ID NO: 692 - DNA, 21 bp, Artificial sequence
  Synthetic sequence: Chemically modified dsRNA targeting E6AP; antisense strand
  modified_base (1)..(1): um
  modified_base (15)..(15): um
  modified_base (17)..(17): um
  misc_feature 20: t is deoxy-thymidine-5prime-phosphorothioate
uaggaucucgagaguauactt

SEQ ID NO: 693 - DNA, 21 bp, Artificial sequence
  Synthetic sequence: dsRNA targeting E6AP; antisense strand
uaugagauguagguaaccutt

SEQ ID NO: 694 - DNA, 21 bp, Artificial sequence
  Synthetic sequence: Chemically modified dsRNA targeting E6AP; antisense strand
  misc_feature 20: t is deoxy-thymidine-5prime-phosphorothioate
uaugagauguagguaaccutt

SEQ ID NO: 695 - DNA, 21 bp, Artificial sequence
  Synthetic sequence: Chemically modified dsRNA targeting E6AP; antisense strand
  modified_base (1)..(1): um
  modified_base (10)..(10): um
  modified_base (14)..(14): um
  misc_feature 20: t is deoxy-thymidine-5prime-phosphorothioate
uaugagauguagguaaccutt

SEQ ID NO: 696 - DNA, 21 bp, Artificial sequence
  Synthetic sequence: Chemically modified dsRNA targeting E6AP; antisense strand
  modified_base (1)..(1): um
  modified_base (3)..(3): um
  modified_base (8)..(8): um
  modified_base (10)..(10): um
  modified_base (14)..(14): um
  misc_feature 20: t is deoxy-thymidine-5prime-phosphorothioate
uaugagauguagguaaccutt

SEQ ID NO: 697 - DNA, 21 bp, Artificial sequence
  Synthetic sequence: Chemically modified dsRNA targeting E6AP; antisense strand
  misc_feature 20: t is deoxy-thymidine-5prime-phosphorothioate
uaugagauguagguaaccutt

SEQ ID NO: 698 - DNA, 21 bp, Artificial sequence
  Synthetic sequence: Chemically modified dsRNA targeting E6AP; antisense strand
  modified_base (1)..(1): um
  modified_base (10)..(10): um
  modified_base (14)..(14): um
  misc_feature 20: t is deoxy-thymidine-5prime-phosphorothioate
uaugagauguagguaaccutt

SEQ ID NO: 699 - DNA, 21 bp, Artificial sequence
  Synthetic sequence: Chemically modified dsRNA targeting E6AP; antisense strand
  modified_base (1)..(1): um
  modified_base (3)..(3): um
  modified_base (8)..(8): um
  modified_base (10)..(10): um
  modified_base (14)..(14): um
  misc_feature 20: t is deoxy-thymidine-5prime-phosphorothioate
uaugagauguagguaaccutt

SEQ ID NO: 700 - DNA, 21 bp, Artificial sequence
  Synthetic sequence: dsRNA targeting E6AP; antisense strand
ucuggucugaauaaguacutt

SEQ ID NO: 701 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucuggucugaauaaguacutt

SEQ ID NO: 702 - DNA, 21 bp, Artificial sequence
  Synthetic sequence: Chemically modified dsRNA targeting E6AP; antisense strand
  modified_base (12)..(12): um
  modified_base (16)..(16): um
  misc_feature 20: t is deoxy-thymidine-5prime-phosphorothioate
ucuggucugaauaaguacutt

SEQ ID NO: 703 - DNA, 21 bp, Artificial sequence
  Synthetic sequence: Chemically modified dsRNA targeting E6AP; antisense strand
  modified_base (3)..(3): um
  modified_base (8)..(8): um
  modified_base (12)..(12): um
  modified_base (16)..(16): um
  misc_feature 20: t is deoxy-thymidine-5prime-phosphorothioate
ucuggucugaauaaguacutt

SEQ ID NO: 704 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucuggucugaauaaguacutt

SEQ ID NO: 705 - DNA, 21 bp, Artificial sequence
  Synthetic sequence: Chemically modified dsRNA targeting E6AP; antisense strand
  modified_base (12)..(12): um
  modified_base (16)..(16): um
  misc_feature 20: t is deoxy-thymidine-5prime-phosphorothioate
ucuggucugaauaaguacutt

SEQ ID NO: 706 - DNA, 21 bp, Artificial sequence
  Synthetic sequence: Chemically modified dsRNA targeting E6AP; antisense strand
  modified_base (3)..(3): um
  modified_base (8)..(8): um
  modified_base (12)..(12): um
  modified_base (16)..(16): um
  misc_feature 20: t is deoxy-thymidine-5prime-phosphorothioate
ucuggucugaauaaguacutt

SEQ ID NO: 707 - DNA, 21 bp, Artificial sequence
  Synthetic sequence: dsRNA targeting E6AP; antisense strand
aaauucagauaauuaggautt

SEQ ID NO: 708 - DNA, 21 bp, Artificial sequence
  Synthetic sequence: Chemically modified dsRNA targeting E6AP; antisense strand
  misc_feature 20: t is deoxy-thymidine-5prime-phosphorothioate
aaauucagauaauuaggautt

SEQ ID NO: 709 - DNA, 21 bp, Artificial sequence
  Synthetic sequence: Chemically modified dsRNA targeting E6AP; antisense strand
  modified_base (6)..(6): cm
  modified_base (10)..(10): um
  modified_base (14)..(14): um
  misc_feature 20: t is deoxy-thymidine-5prime-phosphorothioate
aaauucagauaauuaggautt

SEQ ID NO: 710 - DNA, 21 bp, Artificial sequence
  Synthetic sequence: Chemically modified dsRNA targeting E6AP; antisense strand
  modified_base (4)..(4): um
  modified_base (6)..(6): cm
  modified_base (10)..(10): um
  modified_base (13)..(13): um
  misc_feature 20: t is deoxy-thymidine-5prime-phosphorothioate
aaauucagauaauuaggautt

SEQ ID NO: 711 - DNA, 21 bp, Artificial sequence
  Synthetic sequence: Chemically modified dsRNA targeting E6AP; antisense strand
  misc_feature 20: t is deoxy-thymidine-5prime-phosphorothioate
aaauucagauaauuaggautt

SEQ ID NO: 712 - DNA, 21 bp, Artificial sequence
  Synthetic sequence: Chemically modified dsRNA targeting E6AP; antisense strand
  modified_base (6)..(6): cm
  modified_base (10)..(10): um
  modified_base (14)..(14): um
  misc_feature 20: t is deoxy-thymidine-5prime-phosphorothioate
aaauucagauaauuaggautt

SEQ ID NO: 713 - DNA, 21 bp, Artificial sequence
  Synthetic sequence: Chemically modified dsRNA targeting E6AP; antisense strand
  modified_base (4)..(4): um
  modified_base (6)..(6): cm
  modified_base (10)..(10): um
  modified_base (13)..(13): um
  misc_feature 20: t is deoxy-thymidine-5prime-phosphorothioate
aaauucagauaauuaggautt

SEQ ID NO: 714 - DNA, 21 bp, Artificial sequence
  Synthetic sequence: dsRNA targeting E6AP; antisense strand
ugagcuaucaccuauccuutt

SEQ ID NO: 715 - DNA, 21 bp, Artificial sequence
  Synthetic sequence: Chemically modified dsRNA targeting E6AP; antisense strand
  misc_feature 20: t is deoxy-thymidine-5prime-phosphorothioate
ugagcuaucaccuauccuutt

SEQ ID NO: 716 - DNA, 21 bp, Artificial sequence
  Synthetic sequence: Chemically modified dsRNA targeting E6AP; antisense strand
  modified_base (6)..(6): um
  modified_base (9)..(9): cm
  modified_base (13)..(13): um
  misc_feature 20: t is deoxy-thymidine-5prime-phosphorothioate
ugagcuaucaccuauccuutt

SEQ ID NO: 717 - DNA, 21 bp, Artificial sequence
  Synthetic sequence: Chemically modified dsRNA targeting E6AP; antisense strand
  modified_base (1)..(1): um
  modified_base (6)..(6): um
  modified_base (9)..(9): cm
  modified_base (13)..(13): um
  modified_base (18)..(19): um
  misc_feature 20: t is deoxy-thymidine-5prime-phosphorothioate
ugagcuaucaccuauccuutt

SEQ ID NO: 718 - DNA, 21 bp, Artificial sequence
  Synthetic sequence: Chemically modified dsRNA targeting E6AP; antisense strand
  misc_feature 20: t is deoxy-thymidine-5prime-phosphorothioate
ugagcuaucaccuauccuutt

SEQ ID NO: 719 - DNA, 21 bp, Artificial sequence
  Synthetic sequence: Chemically modified dsRNA targeting E6AP; antisense strand
  modified_base (6)..(6): um
  modified_base (9)..(9): cm
  modified_base (13)..(13): um
  misc_feature 20: t is deoxy-thymidine-5prime-phosphorothioate
ugagcuaucaccuauccuutt

SEQ ID NO: 720 - DNA, 21 bp, Artificial sequence
  Synthetic sequence: Chemically modified dsRNA targeting E6AP; antisense strand
  modified_base (1)..(1): um
  modified_base (6)..(6): um
  modified_base (9)..(9): cm
  modified_base (13)..(13): um
  modified_base (18)..(19): um
  misc_feature 20: t is deoxy-thymidine-5prime-phosphorothioate
ugagcuaucaccuauccuutt

SEQ ID NO: 721 - DNA, 21 bp, Artificial sequence
  Synthetic sequence: dsRNA targeting E6AP; antisense strand
aaucuagauuccggcuucctt

SEQ ID NO: 722 - DNA, 21 bp, Artificial sequence
  Synthetic sequence: Chemically modified dsRNA targeting E6AP; antisense strand
  misc_feature 20: t is deoxy-thymidine-5prime-phosphorothioate
aaucuagauuccggcuucctt

SEQ ID NO: 723 - DNA, 21 bp, Artificial sequence
  Synthetic sequence: Chemically modified dsRNA targeting E6AP; antisense strand
  modified_base (5)..(5): um
  misc_feature 20: t is deoxy-thymidine-5prime-phosphorothioate
aaucuagauuccggcuucctt

SEQ ID NO: 724 - DNA, 21 bp, Artificial sequence
  Synthetic sequence: Chemically modified dsRNA targeting E6AP; antisense strand
  modified_base (5)..(5): um
  modified_base (9)..(9): um
  modified_base (16)..(16): um
  misc_feature 20: t is deoxy-thymidine-5prime-phosphorothioate
aaucuagauuccggcuucctt

SEQ ID NO: 725 - DNA, 21 bp, Artificial sequence
  Synthetic sequence: Chemically modified dsRNA targeting E6AP; antisense strand
  misc_feature 20: t is deoxy-thymidine-5prime-phosphorothioate
aaucuagauuccggcuucctt

SEQ ID NO: 726 - DNA, 21 bp, Artificial sequence
  Synthetic sequence: Chemically modified dsRNA targeting E6AP; antisense strand
  modified_base (5)..(5): um
  misc_feature 20: t is deoxy-thymidine-5prime-phosphorothioate
aaucuagauuccggcuucctt

SEQ ID NO: 727 - DNA, 21 bp, Artificial sequence
  Synthetic sequence: Chemically modified dsRNA targeting E6AP; antisense strand
  modified_base (5)..(5): um
  modified_base (9)..(9): um
  modified_base (16)..(16): um
  misc_feature 20: t is deoxy-thymidine-5prime-phosphorothioate
aaucuagauuccggcuucctt

SEQ ID NO: 728 - DNA, 21 bp, Artificial sequence
  Synthetic sequence: dsRNA targeting E6AP; antisense strand
uuucaagcacuucgaagcatt

SEQ ID NO: 729 - DNA, 21 bp, Artificial sequence
  Synthetic sequence: Chemically modified dsRNA targeting E6AP; antisense strand
  misc_feature 20: t is deoxy-thymidine-5prime-phosphorothioate
uuucaagcacuucgaagcatt

SEQ ID NO: 730 - DNA, 21 bp, Artificial sequence
  Synthetic sequence: Chemically modified dsRNA targeting E6AP; antisense strand
  modified_base (4)..(4): cm
  modified_base (8)..(8): cm
  modified_base (18)..(18): cm
  misc_feature 20: t is deoxy-thymidine-5prime-phosphorothioate
uuucaagcacuucgaagcatt

SEQ ID NO: 731 - DNA, 21 bp, Artificial sequence
  Synthetic sequence: Chemically modified dsRNA targeting E6AP; antisense strand
  modified_base (1)..(2): um
  modified_base (4)..(4): cm
  modified_base (8)..(8): cm
  modified_base (11)..(11): um
  modified_base (18)..(18): cm
  misc_feature 20: t is deoxy-thymidine-5prime-phosphorothioate
uuucaagcacuucgaagcatt

SEQ ID NO: 732 - DNA, 21 bp, Artificial sequence
  Synthetic sequence: Chemically modified dsRNA targeting E6AP; antisense strand
  misc_feature 20: t is deoxy-thymidine-5prime-phosphorothioate
uuucaagcacuucgaagcatt

SEQ ID NO: 733 - DNA, 21 bp, Artificial sequence
  Synthetic sequence: Chemically modified dsRNA targeting E6AP; antisense strand
  modified_base (4)..(4): cm
  modified_base (8)..(8): cm
  modified_base (18)..(18): cm
  misc_feature 20: t is deoxy-thymidine-5prime-phosphorothioate
uuucaagcacuucgaagcatt

SEQ ID NO: 734 - DNA, 21 bp, Artificial sequence
  Synthetic sequence: Chemically modified dsRNA targeting E6AP; antisense strand
  modified_base (1)..(2): um
  modified_base (4)..(4): cm
  modified_base (8)..(8): cm
  modified_base (11)..(11): um
  modified_base (18)..(18): cm
  misc_feature 20: t is deoxy-thymidine-5prime-phosphorothioate
uuucaagcacuucgaagcatt

SEQ ID NO: 735 - DNA, 21 bp, Artificial sequence
  Synthetic sequence: dsRNA targeting E6AP; antisense strand
agugguuuucgacaauccatt

SEQ ID NO: 736 - DNA, 21 bp, Artificial sequence
  Synthetic sequence: Chemically modified dsRNA targeting E6AP; antisense strand
  misc_feature 20: t is deoxy-thymidine-5prime-phosphorothioate
agugguuuucgacaauccatt

SEQ ID NO: 737 - DNA, 21 bp, Artificial sequence
  Synthetic sequence: Chemically modified dsRNA targeting E6AP; antisense strand
  modified_base (13)..(13): cm
  modified_base (18)..(18): cm
  misc_feature 20: t is deoxy-thymidine-5prime-phosphorothioate
agugguuuucgacaauccatt

SEQ ID NO: 738 - DNA, 21 bp, Artificial sequence
  Synthetic sequence: Chemically modified dsRNA targeting E6AP; antisense strand
  modified_base (3)..(3): um
  modified_base (6)..(8): um
  modified_base (13)..(13): cm
  modified_base (18)..(18): cm
  misc_feature 20: t is deoxy-thymidine-5prime-phosphorothioate
agugguuuucgacaauccatt

SEQ ID NO: 739 - DNA, 21 bp, Artificial sequence
  Synthetic sequence: Chemically modified dsRNA targeting E6AP; antisense strand
  misc_feature 20: t is deoxy-thymidine-5prime-phosphorothioate
agugguuuucgacaauccatt

SEQ ID NO: 740 - DNA, 21 bp, Artificial sequence
  Synthetic sequence: Chemically modified dsRNA targeting E6AP; antisense strand
  modified_base (13)..(13): cm
  modified_base (18)..(18): cm
  misc_feature 20: t is deoxy-thymidine-5prime-phosphorothioate
agugguuuucgacaauccatt

SEQ ID NO: 741 - DNA, 21 bp, Artificial sequence
  Synthetic sequence: Chemically modified dsRNA targeting E6AP; antisense strand
  modified_base (3)..(3): um
  modified_base (6)..(8): um
  modified_base (13)..(13): cm
  modified_base (18)..(18): cm
  misc_feature 20: t is deoxy-thymidine-5prime-phosphorothioate
agugguuuucgacaauccatt

SEQ ID NO: 742 - DNA, 21 bp, Artificial sequence
  Synthetic sequence: dsRNA targeting E6AP; antisense strand
uagcgaucaucucuagccgtt

SEQ ID NO: 743 - DNA, 21 bp, Artificial sequence
  Synthetic sequence: Chemically modified dsRNA targeting E6AP; antisense strand
  misc_feature 20: t is deoxy-thymidine-5prime-phosphorothioate
uagcgaucaucucuagccgtt

SEQ ID NO: 744 - DNA, 21 bp, Artificial sequence
  Synthetic sequence: Chemically modified dsRNA targeting E6AP; antisense strand
  modified_base (1)..(1): um
  modified_base (8)..(8): cm
  modified_base (14)..(14): um
  misc_feature 20: t is deoxy-thymidine-5prime-phosphorothioate
uagcgaucaucucuagccgtt

SEQ ID NO: 745 - DNA, 21 bp, Artificial sequence
  Synthetic sequence: Chemically modified dsRNA targeting E6AP; antisense strand
  modified_base (1)..(1): um
  modified_base (8)..(8): cm
  modified_base (14)..(14): um
  misc_feature 20: t is deoxy-thymidine-5prime-phosphorothioate
uagcgaucaucucuagccgtt

SEQ ID NO: 746 - DNA, 21 bp, Artificial sequence
  Synthetic sequence: Chemically modified dsRNA targeting E6AP; antisense strand
  misc_feature 20: t is deoxy-thymidine-5prime-phosphorothioate
uagcgaucaucucuagccgtt

SEQ ID NO: 747 - DNA, 21 bp, Artificial sequence
  Synthetic sequence: Chemically modified dsRNA targeting E6AP; antisense strand
  modified_base (1)..(1): um
  modified_base (8)..(8): cm
  modified_base (14)..(14): um
  misc_feature 20: t is deoxy-thymidine-5prime-phosphorothioate
uagcgaucaucucuagccgtt

SEQ ID NO: 748 - DNA, 21 bp, Artificial sequence
  Synthetic sequence: Chemically modified dsRNA targeting E6AP; antisense strand
  modified_base (1)..(1): um
  modified_base (8)..(8): cm
  modified_base (14)..(14): um
  misc_feature 20: t is deoxy-thymidine-5prime-phosphorothioate
uagcgaucaucucuagccgtt

SEQ ID NO: 749 - DNA, 21 bp, Artificial sequence
  Synthetic sequence: dsRNA targeting E6AP; antisense strand
uucacuagauuucgacugutt

SEQ ID NO: 750 - DNA, 21 bp, Artificial sequence
  Synthetic sequence: Chemically modified dsRNA targeting E6AP; antisense strand
  misc_feature 20: t is deoxy-thymidine-5prime-phosphorothioate
uucacuagauuucgacugutt

SEQ ID NO: 751 - DNA, 21 bp, Artificial sequence
  Synthetic sequence: Chemically modified dsRNA targeting E6AP; antisense strand
  modified_base (3)..(3): cm
  modified_base (6)..(6): um
  misc_feature 20: t is deoxy-thymidine-5prime-phosphorothioate
uucacuagauuucgacugutt

SEQ ID NO: 752 - DNA, 21 bp, Artificial sequence
  Synthetic sequence: Chemically modified dsRNA targeting E6AP; antisense strand
  modified_base (1)..(2): um
  modified_base (3)..(3): cm
  modified_base (6)..(6): um
  modified_base (10)..(11): um
  modified_base (17)..(17): um
  misc_feature 20: t is deoxy-thymidine-5prime-phosphorothioate
uucacuagauuucgacugutt

SEQ ID NO: 753 - DNA, 21 bp, Artificial sequence
  Synthetic sequence: Chemically modified dsRNA targeting E6AP; antisense strand
  misc_feature 20: t is deoxy-thymidine-5prime-phosphorothioate
uucacuagauuucgacugutt

SEQ ID NO: 754 - DNA, 21 bp, Artificial sequence
  Synthetic sequence: Chemically modified dsRNA targeting E6AP; antisense strand
  modified_base (3)..(3): cm
  modified_base (6)..(6): um
  misc_feature 20: t is deoxy-thymidine-5prime-phosphorothioate
uucacuagauuucgacugutt

SEQ ID NO: 755 - DNA, 21 bp, Artificial sequence
  Synthetic sequence: Chemically modified dsRNA targeting E6AP; antisense strand
  modified_base (1)..(2): um
  modified_base (3)..(3): cm
  modified_base (6)..(6): um
  modified_base (10)..(11): um
  modified_base (17)..(17): um
  misc_feature 20: t is deoxy-thymidine-5prime-phosphorothioate
uucacuagauuucgacugutt

SEQ ID NO: 756 - DNA, 21 bp, Artificial sequence
  Synthetic sequence: dsRNA targeting E6AP; antisense strand
agauaauuaggaucucgagtt

SEQ ID NO: 757 - DNA, 21 bp, Artificial sequence
  Synthetic sequence: Chemically modified dsRNA targeting E6AP; antisense strand
  misc_feature 20: t is deoxy-thymidine-5prime-phosphorothioate
agauaauuaggaucucgagtt

SEQ ID NO: 758 - DNA, 21 bp, Artificial sequence
  Synthetic sequence: Chemically modified dsRNA targeting E6AP; antisense strand
  modified_base (4)..(4): um
  modified_base (8)..(8): um
  misc_feature 20: t is deoxy-thymidine-5prime-phosphorothioate
agauaauuaggaucucgagtt

SEQ ID NO: 759 - DNA, 21 bp, Artificial sequence
  Synthetic sequence: Chemically modified dsRNA targeting E6AP; antisense strand
  modified_base (4)..(4): um
  modified_base (7)..(7): um
  misc_feature 20: t is deoxy-thymidine-5prime-phosphorothioate
agauaauuaggaucucgagtt

SEQ ID NO: 760 - DNA, 21 bp, Artificial sequence
  Synthetic sequence: Chemically modified dsRNA targeting E6AP; antisense strand
  misc_feature 20: t is deoxy-thymidine-5prime-phosphorothioate
agauaauuaggaucucgagtt

SEQ ID NO: 761 - DNA, 21 bp, Artificial sequence
  Synthetic sequence: Chemically modified dsRNA targeting E6AP; antisense strand
  modified_base (4)..(4): um
  modified_base (8)..(8): um
  misc_feature 20: t is deoxy-thymidine-5prime-phosphorothioate
agauaauuaggaucucgagtt

SEQ ID NO: 762 - DNA, 21 bp, Artificial sequence
  Synthetic sequence: Chemically modified dsRNA targeting E6AP; antisense strand
  modified_base (4)..(4): um
  modified_base (7)..(7): um
  misc_feature 20: t is deoxy-thymidine-5prime-phosphorothioate
agauaauuaggaucucgagtt

SEQ ID NO: 763 - DNA, 21 bp, Artificial sequence
  Synthetic sequence: dsRNA targeting E6AP; antisense strand
ucacauuccacguuaggugtt

SEQ ID NO: 764 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucacauuccacguuaggugtt

SEQ ID NO: 765 - DNA, 21 bp, Artificial sequence
  Synthetic sequence: Chemically modified dsRNA targeting E6AP; antisense strand
  modified_base (2)..(2): cm
  modified_base (4)..(4): cm
  modified_base (9)..(9): cm
  modified_base (14)..(14): um
  misc_feature 20: t is deoxy-thymidine-5prime-phosphorothioate
ucacauuccacguuaggugtt

SEQ ID NO: 766 - DNA, 21 bp, Artificial sequence
  Synthetic sequence: Chemically modified dsRNA targeting E6AP; antisense strand
  modified_base (2)..(2): cm
  modified_base (4)..(4): cm
  modified_base (6)..(7): um
  modified_base (9)..(9): cm
  modified_base (13)..(14): um
  modified_base (18)..(18): um
  misc_feature 20: t is deoxy-thymidine-5prime-phosphorothioate
ucacauuccacguuaggugtt

SEQ ID NO: 767 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucacauuccacguuaggugtt

SEQ ID NO: 768 - DNA, 21 bp, Artificial sequence
  Synthetic sequence: Chemically modified dsRNA targeting E6AP; antisense strand
  modified_base (2)..(2): cm
  modified_base (4)..(4): cm
  modified_base (9)..(9): cm
  modified_base (14)..(14): um
  misc_feature 20: t is deoxy-thymidine-5prime-phosphorothioate
ucacauuccacguuaggugtt

SEQ ID NO: 769 - DNA, 21 bp, Artificial sequence
  Synthetic sequence: Chemically modified dsRNA targeting E6AP; antisense strand
  modified_base (2)..(2): cm
  modified_base (4)..(4): cm
  modified_base (6)..(7): um
  modified_base (9)..(9): cm
  modified_base (13)..(14): um
  modified_base (18)..(18): um
  misc_feature 20: t is deoxy-thymidine-5prime-phosphorothioate
ucacauuccacguuaggugtt

SEQ ID NO: 770 - DNA, 21 bp, Artificial sequence
  Synthetic sequence: dsRNA targeting E6AP; antisense strand
uguaaaugaaugaacgauutt

SEQ ID NO: 771 - DNA, 21 bp, Artificial sequence
  Synthetic sequence: Chemically modified dsRNA targeting E6AP; antisense strand
  misc_feature 20: t is deoxy-thymidine-5prime-phosphorothioate
uguaaaugaaugaacgauutt

SEQ ID NO: 772 - DNA, 21 bp, Artificial sequence
  Synthetic sequence: Chemically modified dsRNA targeting E6AP; antisense strand
  modified_base (3)..(3): um
  misc_feature 20: t is deoxy-thymidine-5prime-phosphorothioate
uguaaaugaaugaacgauutt

SEQ ID NO: 773 - DNA, 21 bp, Artificial sequence
  Synthetic sequence: Chemically modified dsRNA targeting E6AP; antisense strand
  modified_base (1)..(1): um
  modified_base (3)..(3): um
  modified_base (7)..(7): um
  modified_base (11)..(11): um
  modified_base (18)..(19): um
  misc_feature 20: t is deoxy-thymidine-5prime-phosphorothioate
uguaaaugaaugaacgauutt

SEQ ID NO: 774 - DNA, 21 bp, Artificial sequence
  Synthetic sequence: Chemically modified dsRNA targeting E6AP; antisense strand
  misc_feature 20: t is deoxy-thymidine-5prime-phosphorothioate
uguaaaugaaugaacgauutt

SEQ ID NO: 775 - DNA, 21 bp, Artificial sequence
  Synthetic sequence: Chemically modified dsRNA targeting E6AP; antisense strand
  modified_base (3)..(3): um
  misc_feature 20: t is deoxy-thymidine-5prime-phosphorothioate
uguaaaugaaugaacgauutt

SEQ ID NO: 776 - DNA, 21 bp, Artificial sequence
  Synthetic sequence: Chemically modified dsRNA targeting E6AP; antisense strand
  modified_base (1)..(1): um
  modified_base (3)..(3): um
  modified_base (7)..(7): um
  modified_base (11)..(11): um
  modified_base (18)..(19): um
  misc_feature 20: t is deoxy-thymidine-5prime-phosphorothioate
uguaaaugaaugaacgauutt

SEQ ID NO: 777 - DNA, 21 bp, Artificial sequence
  Synthetic sequence: dsRNA targeting E6AP; antisense strand
ucccaagucacgaaaaguutt

SEQ ID NO: 778 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucccaagucacgaaaaguutt

SEQ ID NO: 779 - DNA, 21 bp, Artificial sequence
  Synthetic sequence: Chemically modified dsRNA targeting E6AP; antisense strand
  modified_base (4)..(4): cm
  modified_base (9)..(9): cm
  misc_feature 20: t is deoxy-thymidine-5prime-phosphorothioate
ucccaagucacgaaaaguutt

SEQ ID NO: 780 - DNA, 21 bp, Artificial sequence
  Synthetic sequence: Chemically modified dsRNA targeting E6AP; antisense strand
  modified_base (4)..(4): cm
  modified_base (9)..(9): cm
  modified_base (18)..(19): um
  misc_feature 20: t is deoxy-thymidine-5prime-phosphorothioate
ucccaagucacgaaaaguutt

SEQ ID NO: 781 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucccaagucacgaaaaguutt

SEQ ID NO: 782 - DNA, 21 bp, Artificial sequence
  Synthetic sequence: Chemically modified dsRNA targeting E6AP; antisense strand
  modified_base (4)..(4): cm
  modified_base (9)..(9): cm
  misc_feature 20: t is deoxy-thymidine-5prime-phosphorothioate
ucccaagucacgaaaaguutt

SEQ ID NO: 783 - DNA, 21 bp, Artificial sequence
  Synthetic sequence: Chemically modified dsRNA targeting E6AP; antisense strand
  modified_base (4)..(4): cm
  modified_base (9)..(9): cm
  modified_base (18)..(19): um
  misc_feature 20: t is deoxy-thymidine-5prime-phosphorothioate
ucccaagucacgaaaaguutt

SEQ ID NO: 784 - DNA, 21 bp, Artificial sequence
  Synthetic sequence: dsRNA targeting E6AP; antisense strand
ucacuagauuucgacuguutt

SEQ ID NO: 785 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucacuagauuucgacuguutt

SEQ ID NO: 786 - DNA, 21 bp, Artificial sequence
  Synthetic sequence: Chemically modified dsRNA targeting E6AP; antisense strand
  modified_base (2)..(2): cm
  modified_base (5)..(5): um
  misc_feature 20: t is deoxy-thymidine-5prime-phosphorothioate
ucacuagauuucgacuguutt

SEQ ID NO: 787 - DNA, 21 bp, Artificial sequence
  Synthetic sequence: Chemically modified dsRNA targeting E6AP; antisense strand
  modified_base (2)..(2): cm
  modified_base (5)..(5): um
  modified_base (9)..(10): um
  modified_base (16)..(16): um
  modified_base (18)..(19): um
  misc_feature 20: t is deoxy-thymidine-5prime-phosphorothioate
ucacuagauuucgacuguutt

SEQ ID NO: 788 - DNA, 21 bp, Artificial sequence
  Synthetic sequence: Chemically modified dsRNA targeting E6AP; antisense strand
  misc_feature 20: t is deoxy-thymidine-5prime-phosphorothioate
ucacuagauuucgacuguutt

SEQ ID NO: 789 - DNA, 21 bp, Artificial sequence
  Synthetic sequence: Chemically modified dsRNA targeting E6AP; antisense strand
  modified_base (2)..(2): cm
  modified_base (5)..(5): um
  misc_feature 20: t is deoxy-thymidine-5prime-phosphorothioate
ucacuagauuucgacuguutt

SEQ ID NO: 790 - DNA, 21 bp, Artificial sequence
  Synthetic sequence: Chemically modified dsRNA targeting E6AP; antisense strand
  modified_base (2)..(2): cm
  modified_base (5)..(5): um
  modified_base (9)..(10): um
  modified_base (16)..(16): um
  modified_base (18)..(19): um
  misc_feature 20: t is deoxy-thymidine-5prime-phosphorothioate
ucacuagauuucgacuguutt

SEQ ID NO: 791 - DNA, 21 bp, Artificial sequence
  Synthetic sequence: dsRNA targeting E6AP; antisense strand
aagcacaaaacucauucgutt

SEQ ID NO: 792 - DNA, 21 bp, Artificial sequence
  Synthetic sequence: Chemically modified dsRNA targeting E6AP; antisense strand
  misc_feature 20: t is deoxy-thymidine-5prime-phosphorothioate
aagcacaaaacucauucgutt

SEQ ID NO: 793 - DNA, 21 bp, Artificial sequence
  Synthetic sequence: Chemically modified dsRNA targeting E6AP; antisense strand
  modified_base (4)..(4): cm
  modified_base (6)..(6): cm
  modified_base (13)..(13): cm
  misc_feature 20: t is deoxy-thymidine-5prime-phosphorothioate
aagcacaaaacucauucgutt

SEQ ID NO: 794 - DNA, 21 bp, Artificial sequence
  Synthetic sequence: Chemically modified dsRNA targeting E6AP; antisense strand
  modified_base (4)..(4): cm
  modified_base (6)..(6): cm
  modified_base (13)..(13): cm
  modified_base (15)..(15): um
  misc_feature 20: t is deoxy-thymidine-5prime-phosphorothioate
aagcacaaaacucauucgutt

SEQ ID NO: 795 - DNA, 21 bp, Artificial sequence
  Synthetic sequence: Chemically modified dsRNA targeting E6AP; antisense strand
  misc_feature 20: t is deoxy-thymidine-5prime-phosphorothioate
aagcacaaaacucauucgutt

SEQ ID NO: 796 - DNA, 21 bp, Artificial sequence
  Synthetic sequence: Chemically modified dsRNA targeting E6AP; antisense strand
  modified_base (4)..(4): cm
  modified_base (6)..(6): cm
  modified_base (13)..(13): cm
  misc_feature 20: t is deoxy-thymidine-5prime-phosphorothioate
aagcacaaaacucauucgutt

SEQ ID NO: 797 - DNA, 21 bp, Artificial sequence
  Synthetic sequence: Chemically modified dsRNA targeting E6AP; antisense strand
  modified_base (4)..(4): cm
  modified_base (6)..(6): cm
  modified_base (13)..(13): cm
  modified_base (15)..(15): um
  misc_feature 20: t is deoxy-thymidine-5prime-phosphorothioate
aagcacaaaacucauucgutt

SEQ ID NO: 798 - DNA, 21 bp, Artificial sequence
  Synthetic sequence: dsRNA targeting E6AP; antisense strand
uucacuguacaugcgaauutt

SEQ ID NO: 799 - DNA, 21 bp, Artificial sequence
  Synthetic sequence: Chemically modified dsRNA targeting E6AP; antisense strand
  misc_feature 20: t is deoxy-thymidine-5prime-phosphorothioate
uucacuguacaugcgaauutt

SEQ ID NO: 800 - DNA, 21 bp, Artificial sequence
  Synthetic sequence: Chemically modified dsRNA targeting E6AP; antisense strand
  modified_base (3)..(3): cm
  modified_base (8)..(8): um
  modified_base (10)..(10): cm
  misc_feature 20: t is deoxy-thymidine-5prime-phosphorothioate
uucacuguacaugcgaauutt

SEQ ID NO: 801 - DNA, 21 bp, Artificial sequence
  Synthetic sequence: Chemically modified dsRNA targeting E6AP; antisense strand
  modified_base (1)..(1): um
  modified_base (3)..(3): cm
  modified_base (6)..(6): um
  modified_base (8)..(8): um
  modified_base (10)..(10): cm
  modified_base (12)..(12): um
  modified_base (18)..(18): um
  misc_feature 20: t is deoxy-thymidine-5prime-phosphorothioate
uucacuguacaugcgaauutt

SEQ ID NO: 802 - DNA, 21 bp, Artificial sequence
  Synthetic sequence: Chemically modified dsRNA targeting E6AP; antisense strand
  misc_feature 20: t is deoxy-thymidine-5prime-phosphorothioate
uucacuguacaugcgaauutt

SEQ ID NO: 803 - DNA, 21 bp, Artificial sequence
  Synthetic sequence: Chemically modified dsRNA targeting E6AP; antisense strand
  modified_base (3)..(3): cm
  modified_base (8)..(8): um
  modified_base (10)..(10): cm
  misc_feature 20: t is deoxy-thymidine-5prime-phosphorothioate
uucacuguacaugcgaauutt

SEQ ID NO: 804 - DNA, 21 bp, Artificial sequence
  Synthetic sequence: Chemically modified dsRNA targeting E6AP; antisense strand
  modified_base (1)..(1): um
  modified_base (3)..(3): cm
  modified_base (6)..(6): um
  modified_base (8)..(8): um
  modified_base (10)..(10): cm
  modified_base (12)..(12): um
  modified_base (18)..(18): um
  misc_feature 20: t is deoxy-thymidine-5prime-phosphorothioate
uucacuguacaugcgaauutt

SEQ ID NO: 805 - DNA, 21 bp, Artificial sequence
  Synthetic sequence: dsRNA targeting E6AP; antisense strand
uguacaugcgaauucuauutt

SEQ ID NO: 806 - DNA, 21 bp, Artificial sequence
  Synthetic sequence: Chemically modified dsRNA targeting E6AP; antisense strand
  misc_feature 20: t is deoxy-thymidine-5prime-phosphorothioate
uguacaugcgaauucuauutt

SEQ ID NO: 807 - DNA, 21 bp, Artificial sequence
  Synthetic sequence: Chemically modified dsRNA targeting E6AP; antisense strand
  modified_base (3)..(3): um
  modified_base (5)..(5): cm
  modified_base (16)..(16): um
  misc_feature 20: t is deoxy-thymidine-5prime-phosphorothioate
uguacaugcgaauucuauutt

SEQ ID NO: 808 - DNA, 21 bp, Artificial sequence
  Synthetic sequence: Chemically modified dsRNA targeting E6AP; antisense strand
  modified_base (1)..(1): um
  modified_base (3)..(3): um
  modified_base (5)..(5): cm
  modified_base (7)..(7): um
  modified_base (13)..(13): um
  modified_base (16)..(16): um
  modified_base (18)..(18): um
  misc_feature 20: t is deoxy-thymidine-5prime-phosphorothioate
uguacaugcgaauucuauutt

SEQ ID NO: 809 - DNA, 21 bp, Artificial sequence
  Synthetic sequence: Chemically modified dsRNA targeting E6AP; antisense strand
  misc_feature 20: t is deoxy-thymidine-5prime-phosphorothioate
uguacaugcgaauucuauutt

SEQ ID NO: 810 - DNA, 21 bp, Artificial sequence
  Synthetic sequence: Chemically modified dsRNA targeting E6AP; antisense strand
  modified_base (3)..(3): um
  modified_base (5)..(5): cm
  modified_base (16)..(16): um
  misc_feature 20: t is deoxy-thymidine-5prime-phosphorothioate
uguacaugcgaauucuauutt

SEQ ID NO: 811 - DNA, 21 bp, Artificial sequence
  Synthetic sequence: Chemically modified dsRNA targeting E6AP; antisense strand
  modified_base (1)..(1): um
  modified_base (3)..(3): um
  modified_base (5)..(5): cm
  modified_base (7)..(7): um
  modified_base (13)..(13): um
  modified_base (16)..(16): um
  modified_base (18)..(18): um
  misc_feature 20: t is deoxy-thymidine-5prime-phosphorothioate
uguacaugcgaauucuauutt

SEQ ID NO: 812 - DNA, 21 bp, Artificial sequence
  Synthetic sequence: dsRNA targeting E6AP; antisense strand
auacaucauuggguuaccatt

SEQ ID NO: 813 - DNA, 21 bp, Artificial sequence
  Synthetic sequence: Chemically modified dsRNA targeting E6AP; antisense strand
  misc_feature 20: t is deoxy-thymidine-5prime-phosphorothioate
auacaucauuggguuaccatt

SEQ ID NO: 814 - DNA, 21 bp, Artificial sequence
  Synthetic sequence: Chemically modified dsRNA targeting E6AP; antisense strand
  modified_base (2)..(2): um
  modified_base (4)..(4): cm
  modified_base (7)..(7): cm
  modified_base (15)..(15): um
  modified_base (18)..(18): cm
  misc_feature 20: t is deoxy-thymidine-5prime-phosphorothioate
auacaucauuggguuaccatt

SEQ ID NO: 815 - DNA, 21 bp, Artificial sequence
  Synthetic sequence: Chemically modified dsRNA targeting E6AP; antisense strand
  modified_base (2)..(2): um
  modified_base (4)..(4): cm
  modified_base (7)..(7): cm
  modified_base (9)..(9): um
  modified_base (14)..(14): um
  modified_base (18)..(18): cm
  misc_feature 20: t is deoxy-thymidine-5prime-phosphorothioate
auacaucauuggguuaccatt

SEQ ID NO: 816 - DNA, 21 bp, Artificial sequence
  Synthetic sequence: Chemically modified dsRNA targeting E6AP; antisense strand
  misc_feature 20: t is deoxy-thymidine-5prime-phosphorothioate
auacaucauuggguuaccatt

SEQ ID NO: 817 - DNA, 21 bp, Artificial sequence
  Synthetic sequence: Chemically modified dsRNA targeting E6AP; antisense strand
  modified_base (2)..(2): um
  modified_base (4)..(4): cm
  modified_base (7)..(7): cm
  modified_base (15)..(15): um
  modified_base (18)..(18): cm
  misc_feature 20: t is deoxy-thymidine-5prime-phosphorothioate
auacaucauuggguuaccatt

SEQ ID NO: 818 - DNA, 21 bp, Artificial sequence
  Synthetic sequence: Chemically modified dsRNA targeting E6AP; antisense strand
  modified_base (2)..(2): um
  modified_base (4)..(4): cm
  modified_base (7)..(7): cm
  modified_base (9)..(9): um
  modified_base (14)..(14): um
  modified_base (18)..(18): cm
  misc_feature 20: t is deoxy-thymidine-5prime-phosphorothioate
auacaucauuggguuaccatt

SEQ ID NO: 819 - RNA, 23 nt, Artificial sequence
  Synthetic sequence: Target sequence of mRNA from HPV E1 reference sequence; sequence of total 19mer target site + aa at both ends
aaaaaucaacguguugcgauuaa

SEQ ID NO: 820 - RNA, 23 nt, Artificial sequence
  Synthetic sequence: Target sequence of mRNA from HPV E1 reference sequence; sequence of total 19mer target site + aa at both ends
aagagccuccaaaauugcguaaa

SEQ ID NO: 821 - RNA, 23 nt, Artificial sequence
  Synthetic sequence: Target sequence of mRNA from HPV E1 reference sequence; sequence of total 19mer target site + aa at both ends
aaucaacguguugcgauugguaa

SEQ ID NO: 822 - RNA, 23 nt, Artificial sequence
  Synthetic sequence: Target sequence of mRNA from HPV E1 reference sequence; sequence of total 19mer target site + aa at both ends
aauccaaaauugcguaguacaaa

SEQ ID NO: 823 - RNA, 23 nt, Artificial sequence
  Synthetic sequence: Target sequence of mRNA from HPV E1 reference sequence; sequence of total 19mer target site + aa at both ends
aaaaucaacguguugcgauugaa

SEQ ID NO: 824 - RNA, 23 nt, Artificial sequence
  Synthetic sequence: Target sequence of mRNA from HPV E1 reference sequence; sequence of total 19mer target site + aa at both ends
aaccuccaaaauugcguaguaaa

SEQ ID NO: 825 - RNA, 23 nt, Artificial sequence
  Synthetic sequence: Target sequence of mRNA from HPV E1 reference sequence; sequence of total 19mer target site + aa at both ends
aaagagccuccaaaauugcguaa

SEQ ID NO: 826 - RNA, 23 nt, Artificial sequence
  Synthetic sequence: Target sequence of mRNA from HPV E1 reference sequence; sequence of total 19mer target site + aa at both ends
aacaacguguugcgauuggugaa

SEQ ID NO: 827 - RNA, 23 nt, Artificial sequence
  Synthetic sequence: Target sequence of mRNA from HPV E1 reference sequence; sequence of total 19mer target site + aa at both ends
aaauagaugugauaggguagaaa

SEQ ID NO: 828 - RNA, 23 nt, Artificial sequence
  Synthetic sequence: Target sequence of mRNA from HPV E1 reference sequence; sequence of total 19mer target site + aa at both ends
aagggaagaggguacgggaugaa

SEQ ID NO: 829 - RNA, 23 nt, Artificial sequence
  Synthetic sequence: Target sequence of mRNA from HPV E1 reference sequence; sequence of total 19mer target site + aa at both ends
aaagauuaaguuugcacgaggaa

SEQ ID NO: 830 - RNA, 23 nt, Artificial sequence
  Synthetic sequence: Target sequence of mRNA from HPV E1 reference sequence; sequence of total 19mer target site + aa at both ends
aagguaucaagguguagaguuaa

SEQ ID NO: 831 - RNA, 23 nt, Artificial sequence
  Synthetic sequence: Target sequence of mRNA from HPV E1 reference sequence; sequence of total 19mer target site + aa at both ends
aaacuuagugauauuaguggaaa

SEQ ID NO: 832 - RNA, 23 nt, Artificial sequence
  Synthetic sequence: Target sequence of mRNA from HPV E1 reference sequence; sequence of total 19mer target site + aa at both ends
aagagauuauuugaaagcgaaaa

SEQ ID NO: 833 - RNA, 23 nt, Artificial sequence
  Synthetic sequence: Target sequence of mRNA from HPV E1 reference sequence; sequence of total 19mer target site + aa at both ends
aaaacaccauguagucaguauaa

SEQ ID NO: 834 - RNA, 23 nt, Artificial sequence
  Synthetic sequence: Target sequence of mRNA from HPV E1 reference sequence; sequence of total 19mer target site + aa at both ends
aaagccuccaaaauugcguagaa

SEQ ID NO: 835 - RNA, 23 nt, Artificial sequence
  Synthetic sequence: Target sequence of mRNA from HPV E1 reference sequence; sequence of total 19mer target site + aa at both ends
aagccuccaaaauugcguaguaa

SEQ ID NO: 836 - RNA, 23 nt, Artificial sequence
  Synthetic sequence: Target sequence of mRNA from HPV E1 reference sequence; sequence of total 19mer target site + aa at both ends
aaguguauggagacacgccagaa

SEQ ID NO: 837 - RNA, 23 nt, Artificial sequence
  Synthetic sequence: Target sequence of mRNA from HPV E1 reference sequence; sequence of total 19mer target site + aa at both ends
aaguacaaugggccuacgauaaa

SEQ ID NO: 838 - RNA, 23 nt, Artificial sequence
  Synthetic sequence: Target sequence of mRNA from HPV E1 reference sequence; sequence of total 19mer target site + aa at both ends
aauacaaugggccuacgauaaaa

SEQ ID NO: 839 - RNA, 23 nt, Artificial sequence
  Synthetic sequence: Target sequence of mRNA from HPV E1 reference sequence; sequence of total 19mer target site + aa at both ends
aaugacauaguagacgauaguaa

SEQ ID NO: 840 - RNA, 23 nt, Artificial sequence
  Synthetic sequence: Target sequence of mRNA from HPV E1 reference sequence; sequence of total 19mer target site + aa at both ends
aagacauaguagacgauagugaa

SEQ ID NO: 841 - RNA, 23 nt, Artificial sequence
  Synthetic sequence: Target sequence of mRNA from HPV E1 reference sequence; sequence of total 19mer target site + aa at both ends
aaacucuuugccaacguuuaaaa

SEQ ID NO: 842 - RNA, 23 nt, Artificial sequence
  Synthetic sequence: Target sequence of mRNA from HPV E1 reference sequence; sequence of total 19mer target site + aa at both ends
aaauaaugacauaguagacgaaa

SEQ ID NO: 843 - RNA, 23 nt, Artificial sequence
  Synthetic sequence: Target sequence of mRNA from HPV E1 reference sequence; sequence of total 19mer target site + aa at both ends
aaaaguauuuggguaguccacaa

SEQ ID NO: 844 - RNA, 23 nt, Artificial sequence
  Synthetic sequence: Target sequence of mRNA from HPV E1 reference sequence; sequence of total 19mer target site + aa at both ends
aaacguguugcgauugguguaaa

SEQ ID NO: 845 - RNA, 23 nt, Artificial sequence
  Synthetic sequence: Target sequence of mRNA from HPV E1 reference sequence; sequence of total 19mer target site + aa at both ends
aacgaaaguauuuggguagucaa

SEQ ID NO: 846 - RNA, 23 nt, Artificial sequence
  Synthetic sequence: Target sequence of mRNA from HPV E1 reference sequence; sequence of total 19mer target site + aa at both ends
aacuccaaaauugcguaguacaa

SEQ ID NO: 847 - RNA, 23 nt, Artificial sequence
  Synthetic sequence: Target sequence of mRNA from HPV E1 reference sequence; sequence of total 19mer target site + aa at both ends
aaugguacaaugggccuacgaaa

SEQ ID NO: 848 - RNA, 23 nt, Artificial sequence
  Synthetic sequence: Target sequence of mRNA from HPV E1 reference sequence; sequence of total 19mer target site + aa at both ends
aauaaugacauaguagacgauaa

SEQ ID NO: 849 - RNA, 23 nt, Artificial sequence
  Synthetic sequence: Target sequence of mRNA from HPV E1 reference sequence; sequence of total 19mer target site + aa at both ends
aaacauaguagacgauagugaaa

SEQ ID NO: 850 - RNA, 23 nt, Artificial sequence
  Synthetic sequence: Target sequence of mRNA from HPV E1 reference sequence; sequence of total 19mer target site + aa at both ends
aaguguagacauuauaaacgaaa

SEQ ID NO: 851 - RNA, 23 nt, Artificial sequence
  Synthetic sequence: Target sequence of mRNA from HPV E1 reference sequence; sequence of total 19mer target site + aa at both ends
aauagacauuauaaacgagcaaa

SEQ ID NO: 852 - RNA, 23 nt, Artificial sequence
  Synthetic sequence: Target sequence of mRNA from HPV E1 reference sequence; sequence of total 19mer target site + aa at both ends
aauugcgauugguguauugcuaa

SEQ ID NO: 853 - RNA, 23 nt, Artificial sequence
  Synthetic sequence: Target sequence of mRNA from HPV E1 reference sequence; sequence of total 19mer target site + aa at both ends
aauuggcagacacuaauaguaaa

SEQ ID NO: 854 - RNA, 23 nt, Artificial sequence
  Synthetic sequence: Target sequence of mRNA from HPV E1 reference sequence; sequence of total 19mer target site + aa at both ends
aauucagaauuaguaagaccaaa

SEQ ID NO: 855 - RNA, 23 nt, Artificial sequence
  Synthetic sequence: Target sequence of mRNA from HPV E1 reference sequence; sequence of total 19mer target site + aa at both ends
aaggagauuauuugaaagcgaaa

SEQ ID NO: 856 - RNA, 23 nt, Artificial sequence
  Synthetic sequence: Target sequence of mRNA from HPV E1 reference sequence; sequence of total 19mer target site + aa at both ends
aaaccauguagucaguauaguaa

SEQ ID NO: 857 - RNA, 23 nt, Artificial sequence
  Synthetic sequence: Target sequence of mRNA from HPV E1 reference sequence; sequence of total 19mer target site + aa at both ends
aagaagaggguacgggauguaaa

SEQ ID NO: 858 - RNA, 23 nt, Artificial sequence
  Synthetic sequence: Target sequence of mRNA from HPV E1 reference sequence; sequence of total 19mer target site + aa at both ends
aaauaaaucaacguguugcgaaa

SEQ ID NO: 859 - RNA, 23 nt, Artificial sequence
  Synthetic sequence: Target sequence of mRNA from HPV E1 reference sequence; sequence of total 19mer target site + aa at both ends
aacguguugcgauugguguauaa

SEQ ID NO: 860 - RNA, 23 nt, Artificial sequence
  Synthetic sequence: Target sequence of mRNA from HPV E1 reference sequence; sequence of total 19mer target site + aa at both ends
aaugggccuacgauaaugacaaa

SEQ ID NO: 861 - RNA, 23 nt, Artificial sequence
  Synthetic sequence: Target sequence of mRNA from HPV E1 reference sequence; sequence of total 19mer target site + aa at both ends
aaugcauauuacuauauggugaa

SEQ ID NO: 862 - RNA, 23 nt, Artificial sequence
  Synthetic sequence: Target sequence of mRNA from HPV E1 reference sequence; sequence of total 19mer target site + aa at both ends
aaccagauuaaguuugcacgaaa

SEQ ID NO: 863 - RNA, 23 nt, Artificial sequence
  Synthetic sequence: Target sequence of mRNA from HPV E1 reference sequence; sequence of total 19mer target site + aa at both ends
aaagauuauuugaaagcgaagaa

SEQ ID NO: 864 - RNA, 23 nt, Artificial sequence
  Synthetic sequence: Target sequence of mRNA from HPV E1 reference sequence; sequence of total 19mer target site + aa at both ends
aaguuacagguagaagggcgcaa

SEQ ID NO: 865 - RNA, 23 nt, Artificial sequence
  Synthetic sequence: Target sequence of mRNA from HPV E1 reference sequence; sequence of total 19mer target site + aa at both ends
aagccaaaauagguauguuagaa

SEQ ID NO: 866 - RNA, 23 nt, Artificial sequence
  Synthetic sequence: Target sequence of mRNA from HPV E1 reference sequence; sequence of total 19mer target site + aa at both ends
aagcauagaccauugguacaaaa

SEQ ID NO: 867 - RNA, 23 nt, Artificial sequence
  Synthetic sequence: Target sequence of mRNA from HPV E1 reference sequence; sequence of total 19mer target site + aa at both ends
aaaaauugcguaguacagcagaa

SEQ ID NO: 868 - RNA, 23 nt, Artificial sequence
  Synthetic sequence: Target sequence of mRNA from HPV E1 reference sequence; sequence of total 19mer target site + aa at both ends
aaaguauuuggguaguccacuaa

SEQ ID NO: 869 - RNA, 23 nt, Artificial sequence
  Synthetic sequence: Target sequence of mRNA from HPV E1 reference sequence; sequence of total 19mer target site + aa at both ends
aaaugacauaguagacgauagaa

SEQ ID NO: 870 - RNA, 23 nt, Artificial sequence
  Synthetic sequence: Target sequence of mRNA from HPV E1 reference sequence; sequence of total 19mer target site + aa at both ends
aagguaguccacuuagugauaaa

SEQ ID NO: 871 - RNA, 23 nt, Artificial sequence
  Synthetic sequence: Target sequence of mRNA from HPV E1 reference sequence; sequence of total 19mer target site + aa at both ends
aaagcauagaccauugguacaaa

SEQ ID NO: 872 - RNA, 23 nt, Artificial sequence
  Synthetic sequence: Target sequence of mRNA from HPV E1 reference sequence; sequence of total 19mer target site + aa at both ends
aauuucagaauuaguaagaccaa

SEQ ID NO: 873 - RNA, 23 nt, Artificial sequence
  Synthetic sequence: Target sequence of mRNA from HPV E1 reference sequence; sequence of total 19mer target site + aa at both ends
aaugcgauugguguauugcugaa

SEQ ID NO: 874 - RNA, 23 nt, Artificial sequence
  Synthetic sequence: Target sequence of mRNA from HPV E1 reference sequence; sequence of total 19mer target site + aa at both ends
aaccaaaauugcguaguacagaa

SEQ ID NO: 875 - RNA, 23 nt, Artificial sequence
  Synthetic sequence: Target sequence of mRNA from HPV E1 reference sequence; sequence of total 19mer target site + aa at both ends
aagacagcacaugcguuguuuaa

SEQ ID NO: 876 - RNA, 23 nt, Artificial sequence
  Synthetic sequence: Target sequence of mRNA from HPV E1 reference sequence; sequence of total 19mer target site + aa at both ends
aauguuacagguagaagggcgaa

SEQ ID NO: 877 - RNA, 23 nt, Artificial sequence
  Synthetic sequence: Target sequence of mRNA from HPV E1 reference sequence; sequence of total 19mer target site + aa at both ends
aaagacaauaauauuaguccuaa

SEQ ID NO: 878 - RNA, 23 nt, Artificial sequence
  Synthetic sequence: Target sequence of mRNA from HPV E1 reference sequence; sequence of total 19mer target site + aa at both ends
aaaugauuauuuaacacaggcaa

SEQ ID NO: 879 - RNA, 23 nt, Artificial sequence
  Synthetic sequence: Target sequence of mRNA from HPV E1 reference sequence; sequence of total 19mer target site + aa at both ends
aaagaugugauaggguagaugaa

SEQ ID NO: 880 - RNA, 23 nt, Artificial sequence
  Synthetic sequence: Target sequence of mRNA from HPV E1 reference sequence; sequence of total 19mer target site + aa at both ends
aacugcaagggucuguaauauaa

SEQ ID NO: 881 - RNA, 23 nt, Artificial sequence
  Synthetic sequence: Target sequence of mRNA from HPV E1 reference sequence; sequence of total 19mer target site + aa at both ends
aaucagaugacgagaacgaaaaa

SEQ ID NO: 882 - RNA, 23 nt, Artificial sequence
  Synthetic sequence: Target sequence of mRNA from HPV E1 reference sequence; sequence of total 19mer target site + aa at both ends
aacaccauguagucaguauagaa

SEQ ID NO: 883 - RNA, 23 nt, Artificial sequence
  Synthetic sequence: Target sequence of mRNA from HPV E1 reference sequence; sequence of total 19mer target site + aa at both ends
aaagacagcacaugcguuguuaa

SEQ ID NO: 884 - RNA, 23 nt, Artificial sequence
  Synthetic sequence: Target sequence of mRNA from HPV E1 reference sequence; sequence of total 19mer target site + aa at both ends
aaagaggguacgggauguaauaa

SEQ ID NO: 885 - RNA, 23 nt, Artificial sequence
  Synthetic sequence: Target sequence of mRNA from HPV E1 reference sequence; sequence of total 19mer target site + aa at both ends
aaaaaaguaauaaaucaacguaa

SEQ ID NO: 886 - RNA, 23 nt, Artificial sequence
  Synthetic sequence: Target sequence of mRNA from HPV E1 reference sequence; sequence of total 19mer target site + aa at both ends
aaaaagcauagaccauugguaaa

SEQ ID NO: 887 - RNA, 23 nt, Artificial sequence
  Synthetic sequence: Target sequence of mRNA from HPV E1 reference sequence; sequence of total 19mer target site + aa at both ends
aauuguacauuugaauuaucaaa

SEQ ID NO: 888 - RNA, 23 nt, Artificial sequence
  Synthetic sequence: Target sequence of mRNA from HPV E1 reference sequence; sequence of total 19mer target site + aa at both ends
aaguaaagcauagaccauuggaa

SEQ ID NO: 889 - RNA, 23 nt, Artificial sequence
  Synthetic sequence: Target sequence of mRNA from HPV E1 reference sequence; sequence of total 19mer target site + aa at both ends
aaauaucaaauauuagugaagaa

SEQ ID NO: 890 - RNA, 23 nt, Artificial sequence
  Synthetic sequence: Target sequence of mRNA from HPV E1 reference sequence; sequence of total 19mer target site + aa at both ends
aauaucaaauauuagugaaguaa

SEQ ID NO: 891 - RNA, 23 nt, Artificial sequence
  Synthetic sequence: Target sequence of mRNA from HPV E1 reference sequence; sequence of total 19mer target site + aa at both ends
aaggguauggcaauacugaagaa

SEQ ID NO: 892 - RNA, 23 nt, Artificial sequence
  Synthetic sequence: Target sequence of mRNA from HPV E1 reference sequence; sequence of total 19mer target site + aa at both ends
aacaacguuuaaaugugugucaa

SEQ ID NO: 893 - RNA, 23 nt, Artificial sequence
  Synthetic sequence: Target sequence of mRNA from HPV E1 reference sequence; sequence of total 19mer target site + aa at both ends
aaaacguuuaaaugugugucaaa

SEQ ID NO: 894 - RNA, 23 nt, Artificial sequence
  Synthetic sequence: Target sequence of mRNA from HPV E1 reference sequence; sequence of total 19mer target site + aa at both ends
aagaaaacgauggagacucuuaa

SEQ ID NO: 895 - RNA, 23 nt, Artificial sequence
  Synthetic sequence: Target sequence of mRNA from HPV E1 reference sequence; sequence of total 19mer target site + aa at both ends
aagcggguauggcaauacugaaa

SEQ ID NO: 896 - RNA, 23 nt, Artificial sequence
  Synthetic sequence: Target sequence of mRNA from HPV E1 reference sequence; sequence of total 19mer target site + aa at both ends
aacggguauggcaauacugaaaa

SEQ ID NO: 897 - RNA, 23 nt, Artificial sequence
  Synthetic sequence: Target sequence of mRNA from HPV E1 reference sequence; sequence of total 19mer target site + aa at both ends
aauuauaaacgagcagaaaaaaa

SEQ ID NO: 898 - RNA, 23 nt, Artificial sequence
  Synthetic sequence: Target sequence of mRNA from HPV E1 reference sequence; sequence of total 19mer target site + aa at both ends
aaacaauguguagacauuauaaa

SEQ ID NO: 899 - RNA, 23 nt, Artificial sequence
  Synthetic sequence: Target sequence of mRNA from HPV E1 reference sequence; sequence of total 19mer target site + aa at both ends
aaauuauaaacgagcagaaaaaa

SEQ ID NO: 900 - RNA, 23 nt, Artificial sequence
  Synthetic sequence: Target sequence of mRNA from HPV E1 reference sequence; sequence of total 19mer target site + aa at both ends
aauguguagacauuauaaacgaa

SEQ ID NO: 901 - RNA, 23 nt, Artificial sequence
  Synthetic sequence: Target sequence of mRNA from HPV E1 reference sequence; sequence of total 19mer target site + aa at both ends
aaugugugucaggacaaaauaaa

SEQ ID NO: 902 - RNA, 23 nt, Artificial sequence
  Synthetic sequence: Target sequence of mRNA from HPV E1 reference sequence; sequence of total 19mer target site + aa at both ends
aaacauuauaaacgagcagaaaa

SEQ ID NO: 903 - RNA, 23 nt, Artificial sequence
  Synthetic sequence: Target sequence of mRNA from HPV E1 reference sequence; sequence of total 19mer target site + aa at both ends
aaagacagcggguauggcaauaa

SEQ ID NO: 904 - RNA, 23 nt, Artificial sequence
  Synthetic sequence: Target sequence of mRNA from HPV E1 reference sequence; sequence of total 19mer target site + aa at both ends
aagacagcggguauggcaauaaa

SEQ ID NO: 905 - RNA, 23 nt, Artificial sequence
  Synthetic sequence: Target sequence of mRNA from HPV E1 reference sequence; sequence of total 19mer target site + aa at both ends
aaacagcggguauggcaauacaa

SEQ ID NO: 906 - RNA, 23 nt, Artificial sequence
  Synthetic sequence: Target sequence of mRNA from HPV E1 reference sequence; sequence of total 19mer target site + aa at both ends
aaagcggguauggcaauacugaa

SEQ ID NO: 907 - RNA, 23 nt, Artificial sequence
  Synthetic sequence: Target sequence of mRNA from HPV E1 reference sequence; sequence of total 19mer target site + aa at both ends
aaaacaauguguagacauuauaa

SEQ ID NO: 908 - RNA, 23 nt, Artificial sequence
  Synthetic sequence: Target sequence of mRNA from HPV E1 reference sequence; sequence of total 19mer target site + aa at both ends
aacauuauaaacgagcagaaaaa

SEQ ID NO: 909 - RNA, 23 nt, Artificial sequence
  Synthetic sequence: Target sequence of mRNA from HPV E1 reference sequence; sequence of total 19mer target site + aa at both ends
aaacguuuaaaugugugucagaa

SEQ ID NO: 910 - RNA, 23 nt, Artificial sequence
  Synthetic sequence: Target sequence of mRNA from HPV E1 reference sequence; sequence of total 19mer target site + aa at both ends
aaaaaugugugucaggacaaaaa

SEQ ID NO: 911 - RNA, 23 nt, Artificial sequence
  Synthetic sequence: Target sequence of mRNA from HPV E1 reference sequence; sequence of total 19mer target site + aa at both ends
aagguucuaaaacgaaaguauaa

SEQ ID NO: 912 - RNA, 23 nt, Artificial sequence
  Synthetic sequence: Target sequence of mRNA from HPV E1 reference sequence; sequence of total 19mer target site + aa at both ends
aaauguguagacauuauaaacaa

SEQ ID NO: 913 - RNA, 23 nt, Artificial sequence
  Synthetic sequence: Target sequence of mRNA from HPV E1 reference sequence; sequence of total 19mer target site + aa at both ends
aaaguaagaccauuuaaaaguaa

SEQ ID NO: 914 - RNA, 23 nt, Artificial sequence
  Synthetic sequence: Target sequence of mRNA from HPV E1 reference sequence; sequence of total 19mer target site + aa at both ends
aauaguaagaccauuuaaaagaa

SEQ ID NO: 915 - RNA, 23 nt, Artificial sequence
  Synthetic sequence: Target sequence of mRNA from HPV E1 reference sequence; sequence of total 19mer target site + aa at both ends
aagaauuaguaagaccauuuaaa

SEQ ID NO: 916 - RNA, 23 nt, Artificial sequence
  Synthetic sequence: Target sequence of mRNA from HPV E1 reference sequence; sequence of total 19mer target site + aa at both ends
aaaauuaguaagaccauuuaaaa

SEQ ID NO: 917 - RNA, 23 nt, Artificial sequence
  Synthetic sequence: Target sequence of mRNA from HPV E1 reference sequence; sequence of total 19mer target site + aa at both ends
aaauuaguaagaccauuuaaaaa

SEQ ID NO: 918 - RNA, 23 nt, Artificial sequence
  Synthetic sequence: Target sequence of mRNA from HPV E1 reference sequence; sequence of total 19mer target site + aa at both ends
aauuaguaagaccauuuaaaaaa

SEQ ID NO: 919 - RNA, 23 nt, Artificial sequence
  Synthetic sequence: Target sequence of mRNA from HPV E1 reference sequence; sequence of total 19mer target site + aa at both ends
aaaauacugaaguggaaacucaa

SEQ ID NO: 920 - RNA, 23 nt, Artificial sequence
  Synthetic sequence: Target sequence of mRNA from HPV E1 reference sequence; sequence of total 19mer target site + aa at both ends
aaauacugaaguggaaacucaaa

SEQ ID NO: 921 - RNA, 23 nt, Artificial sequence
  Synthetic sequence: Target sequence of mRNA from HPV E1 reference sequence; sequence of total 19mer target site + aa at both ends
aacaauacugaaguggaaacuaa

SEQ ID NO: 922 - RNA, 23 nt, Artificial sequence
  Synthetic sequence: Target sequence of mRNA from HPV E1 reference sequence; sequence of total 19mer target site + aa at both ends
aauacugaaguggaaacucagaa

SEQ ID NO: 923 - RNA, 23 nt, Artificial sequence
  Synthetic sequence: Target sequence of mRNA from HPV E1 reference sequence; sequence of total 19mer target site + aa at both ends
aaacugaaguggaaacucagcaa

SEQ ID NO: 924 - RNA, 23 nt, Artificial sequence
  Synthetic sequence: Target sequence of mRNA from HPV E1 reference sequence; sequence of total 19mer target site + aa at both ends
aacugaaguggaaacucagcaaa

SEQ ID NO: 925 - RNA, 23 nt, Artificial sequence
  Synthetic sequence: Target sequence of mRNA from HPV E1 reference sequence; sequence of total 19mer target site + aa at both ends
aaugaaguggaaacucagcagaa

SEQ ID NO: 926 - RNA, 23 nt, Artificial sequence
  Synthetic sequence: Target sequence of mRNA from HPV E1 reference sequence; sequence of total 19mer target site + aa at both ends
aagaaguggaaacucagcagaaa

SEQ ID NO: 927 - RNA, 23 nt, Artificial sequence
  Synthetic sequence: Target sequence of mRNA from HPV E1 reference sequence; sequence of total 19mer target site + aa at both ends
aaaaguggaaacucagcagauaa

SEQ ID NO: 928 - RNA, 23 nt, Artificial sequence
  Synthetic sequence: Target sequence of mRNA from HPV E1 reference sequence; sequence of total 19mer target site + aa at both ends
aaaguggaaacucagcagaugaa

SEQ ID NO: 929 - RNA, 23 nt, Artificial sequence
  Synthetic sequence: Target sequence of mRNA from HPV E1 reference sequence; sequence of total 19mer target site + aa at both ends
aaauggcaauacugaaguggaaa

SEQ ID NO: 930 - RNA, 23 nt, Artificial sequence
  Synthetic sequence: Target sequence of mRNA from HPV E1 reference sequence; sequence of total 19mer target site + aa at both ends
aaaaauccuuuuucucaaggaaa

SEQ ID NO: 931 - RNA, 23 nt, Artificial sequence
  Synthetic sequence: Target sequence of mRNA from HPV E1 reference sequence; sequence of total 19mer target site + aa at both ends
aauccuuuuucucaaggacguaa

SEQ ID NO: 932 - RNA, 23 nt, Artificial sequence
  Synthetic sequence: Target sequence of mRNA from HPV E1 reference sequence; sequence of total 19mer target site + aa at both ends
aaauccuuuuucucaaggacgaa

SEQ ID NO: 933 - RNA, 23 nt, Artificial sequence
  Synthetic sequence: Target sequence of mRNA from HPV E1 reference sequence; sequence of total 19mer target site + aa at both ends
aaggcaauacugaaguggaaaaa

SEQ ID NO: 934 - RNA, 23 nt, Artificial sequence
  Synthetic sequence: Target sequence of mRNA from HPV E1 reference sequence; sequence of total 19mer target site + aa at both ends
aacuuuuucucaaggacguggaa

SEQ ID NO: 935 - RNA, 23 nt, Artificial sequence
  Synthetic sequence: Target sequence of mRNA from HPV E1 reference sequence; sequence of total 19mer target site + aa at both ends
aaccuuuuucucaaggacgugaa

SEQ ID NO: 936 - RNA, 23 nt, Artificial sequence
  Synthetic sequence: Target sequence of mRNA from HPV E1 reference sequence; sequence of total 19mer target site + aa at both ends
aauuuuucucaaggacgugguaa

SEQ ID NO: 937 - RNA, 23 nt, Artificial sequence
  Synthetic sequence: Target sequence of mRNA from HPV E1 reference sequence; sequence of total 19mer target site + aa at both ends
aauggaaauccuuuuucucaaaa

SEQ ID NO: 938 - RNA, 23 nt, Artificial sequence
  Synthetic sequence: Target sequence of mRNA from HPV E1 reference sequence; sequence of total 19mer target site + aa at both ends
aaggaaauccuuuuucucaagaa

SEQ ID NO: 939 - RNA, 23 nt, Artificial sequence
  Synthetic sequence: Target sequence of mRNA from HPV E1 reference sequence; sequence of total 19mer target site + aa at both ends
aagaaauccuuuuucucaaggaa

SEQ ID NO: 940 - RNA, 23 nt, Artificial sequence
  Synthetic sequence: Target sequence of mRNA from HPV E1 reference sequence; sequence of total 19mer target site + aa at both ends
aaaauccuuuuucucaaggacaa

SEQ ID NO: 941 - RNA, 23 nt, Artificial sequence
  Synthetic sequence: Target sequence of mRNA from HPV E1 reference sequence; sequence of total 19mer target site + aa at both ends
aauauggcaauacugaaguggaa

SEQ ID NO: 942 - RNA, 23 nt, Artificial sequence
  Synthetic sequence: Target sequence of mRNA from HPV E1 reference sequence; sequence of total 19mer target site + aa at both ends
aauggcaauacugaaguggaaaa

SEQ ID NO: 943 - RNA, 23 nt, Artificial sequence
  Synthetic sequence: Target sequence of mRNA from HPV E1 reference sequence; sequence of total 19mer target site + aa at both ends
aagcaauacugaaguggaaacaa

SEQ ID NO: 944 - RNA, 23 nt, Artificial sequence
  Synthetic sequence: Target sequence of mRNA from HPV E1 reference sequence; sequence of total 19mer target site + aa at both ends
aaaauguguagacauuauaaaaa

SEQ ID NO: 945 - DNA, 21 bp, Artificial sequence
  Synthetic sequence: dsRNA targeting HPV E1 Gene Expression. Sense strand (target sequence) having double TT overhang
aaaucaacguguugcgauutt

SEQ ID NO: 946 - DNA, 21 bp, Artificial sequence
  Synthetic sequence: dsRNA targeting HPV E1 Gene Expression. Sense strand (target sequence) having double TT overhang
gagccuccaaaauugcguatt

SEQ ID NO: 947 - DNA, 21 bp, Artificial sequence
  Synthetic sequence: dsRNA targeting HPV E1 Gene Expression. Sense strand (target sequence) having double TT overhang
ucaacguguugcgauuggutt

SEQ ID NO: 948 - DNA, 21 bp, Artificial sequence
  Synthetic sequence: dsRNA targeting HPV E1 Gene Expression. Sense strand (target sequence) having double TT overhang
uccaaaauugcguaguacatt

SEQ ID NO: 949 - DNA, 21 bp, Artificial sequence
  Synthetic sequence: dsRNA targeting HPV E1 Gene Expression. Sense strand (target sequence) having double TT overhang
aaucaacguguugcgauugtt

SEQ ID NO: 950 - DNA, 21 bp, Artificial sequence
  Synthetic sequence: dsRNA targeting HPV E1 Gene Expression. Sense strand (target sequence) having double TT overhang
ccuccaaaauugcguaguatt

SEQ ID NO: 951 - DNA, 21 bp, Artificial sequence
  Synthetic sequence: dsRNA targeting HPV E1 Gene Expression. Sense strand (target sequence) having double TT overhang
agagccuccaaaauugcgutt

SEQ ID NO: 952 - DNA, 21 bp, Artificial sequence
  Synthetic sequence: dsRNA targeting HPV E1 Gene Expression. Sense strand (target sequence) having double TT overhang
caacguguugcgauuggugtt

SEQ ID NO: 953 - DNA, 21 bp, Artificial sequence
  Synthetic sequence: dsRNA targeting HPV E1 Gene Expression. Sense strand (target sequence) having double TT overhang
auagaugugauaggguagatt

SEQ ID NO: 954 - DNA, 21 bp, Artificial sequence
  Synthetic sequence: dsRNA targeting HPV E1 Gene Expression. Sense strand (target sequence) having double TT overhang
gggaagaggguacgggaugtt

SEQ ID NO: 955 - DNA, 21 bp, Artificial sequence
  Synthetic sequence: dsRNA targeting HPV E1 Gene Expression. Sense strand (target sequence) having double TT overhang
agauuaaguuugcacgaggtt

SEQ ID NO: 956 - DNA, 21 bp, Artificial sequence
  Synthetic sequence: dsRNA targeting HPV E1 Gene Expression. Sense strand (target sequence) having double TT overhang
gguaucaagguguagaguutt

SEQ ID NO: 957 - DNA, 21 bp, Artificial sequence
  Synthetic sequence: dsRNA targeting HPV E1 Gene Expression. Sense strand (target sequence) having double TT overhang
acuuagugauauuaguggatt

SEQ ID NO: 958 - DNA, 21 bp, Artificial sequence
  Synthetic sequence: dsRNA targeting HPV E1 Gene Expression. Sense strand (target sequence) having double TT overhang
gagauuauuugaaagcgaatt

SEQ ID NO: 959 - DNA, 21 bp, Artificial sequence
  Synthetic sequence: dsRNA targeting HPV E1 Gene Expression. Sense strand (target sequence) having double TT overhang
aacaccauguagucaguautt

SEQ ID NO: 960 - DNA, 21 bp, Artificial sequence
  Synthetic sequence: dsRNA targeting HPV E1 Gene Expression. Sense strand (target sequence) having double TT overhang
agccuccaaaauugcguagtt

SEQ ID NO: 961 - DNA, 21 bp, Artificial sequence
  Synthetic sequence: dsRNA targeting HPV E1 Gene Expression. Sense strand (target sequence) having double TT overhang
gccuccaaaauugcguagutt

SEQ ID NO: 962 - DNA, 21 bp, Artificial sequence
  Synthetic sequence: dsRNA targeting HPV E1 Gene Expression. Sense strand (target sequence) having double TT overhang
guguauggagacacgccagtt

SEQ ID NO: 963 - DNA, 21 bp, Artificial sequence
  Synthetic sequence: dsRNA targeting HPV E1 Gene Expression. Sense strand (target sequence) having double TT overhang
guacaaugggccuacgauatt

SEQ ID NO: 964 - DNA, 21 bp, Artificial sequence
  Synthetic sequence: dsRNA targeting HPV E1 Gene Expression. Sense strand (target sequence) having double TT overhang
uacaaugggccuacgauaatt

SEQ ID NO: 965 - DNA, 21 bp, Artificial sequence
  Synthetic sequence: dsRNA targeting HPV E1 Gene Expression. Sense strand (target sequence) having double TT overhang
ugacauaguagacgauagutt

SEQ ID NO: 966 - DNA, 21 bp, Artificial sequence
  Synthetic sequence: dsRNA targeting HPV E1 Gene Expression. Sense strand (target sequence) having double TT overhang
gacauaguagacgauagugtt

SEQ ID NO: 967 - DNA, 21 bp, Artificial sequence
  Synthetic sequence: dsRNA targeting HPV E1 Gene Expression. Sense strand (target sequence) having double TT overhang
acucuuugccaacguuuaatt

SEQ ID NO: 968 - DNA, 21 bp, Artificial sequence
  Synthetic sequence: dsRNA targeting HPV E1 Gene Expression. Sense strand (target sequence) having double TT overhang
auaaugacauaguagacgatt

SEQ ID NO: 969 - DNA, 21 bp, Artificial sequence
  Synthetic sequence: dsRNA targeting HPV E1 Gene Expression. Sense strand (target sequence) having double TT overhang
aaguauuuggguaguccactt

SEQ ID NO: 970 - DNA, 21 bp, Artificial sequence
  Synthetic sequence: dsRNA targeting HPV E1 Gene Expression. Sense strand (target sequence) having double TT overhang
acguguugcgauugguguatt

SEQ ID NO: 971 - DNA, 21 bp, Artificial sequence
  Synthetic sequence: dsRNA targeting HPV E1 Gene Expression. Sense strand (target sequence) having double TT overhang
cgaaaguauuuggguaguctt

SEQ ID NO: 972 - DNA, 21 bp, Artificial sequence
  Synthetic sequence: dsRNA targeting HPV E1 Gene Expression. Sense strand (target sequence) having double TT overhang
cuccaaaauugcguaguactt

SEQ ID NO: 973 - DNA, 21 bp, Artificial sequence
  Synthetic sequence: dsRNA targeting HPV E1 Gene Expression. Sense strand (target sequence) having double TT overhang
ugguacaaugggccuacgatt

SEQ ID NO: 974 - DNA, 21 bp, Artificial sequence
  Synthetic sequence: dsRNA targeting HPV E1 Gene Expression. Sense strand (target sequence) having double TT overhang
uaaugacauaguagacgautt

SEQ ID NO: 975 - DNA, 21 bp, Artificial sequence
  Synthetic sequence: dsRNA targeting HPV E1 Gene Expression. Sense strand (target sequence) having double TT overhang
acauaguagacgauagugatt

SEQ ID NO: 976 - DNA, 21 bp, Artificial sequence
  Synthetic sequence: dsRNA targeting HPV E1 Gene Expression. Sense strand (target sequence) having double TT overhang
guguagacauuauaaacgatt

SEQ ID NO: 977 - DNA, 21 bp, Artificial sequence
  Synthetic sequence: dsRNA targeting HPV E1 Gene Expression. Sense strand (target sequence) having double TT overhang
uagacauuauaaacgagcatt

SEQ ID NO: 978 - DNA, 21 bp, Artificial sequence
  Synthetic sequence: dsRNA targeting HPV E1 Gene Expression. Sense strand (target sequence) having double TT overhang
uugcgauugguguauugcutt

SEQ ID NO: 979 - DNA, 21 bp, Artificial sequence
  Synthetic sequence: dsRNA targeting HPV E1 Gene Expression. Sense strand (target sequence) having double TT overhang
uuggcagacacuaauaguatt

SEQ ID NO: 980 - DNA, 21 bp, Artificial sequence
  Synthetic sequence: dsRNA targeting HPV E1 Gene Expression. Sense strand (target sequence) having double TT overhang
uucagaauuaguaagaccatt

SEQ ID NO: 981 - DNA, 21 bp, Artificial sequence
  Synthetic sequence: dsRNA targeting HPV E1 Gene Expression. Sense strand (target sequence) having double TT overhang
ggagauuauuugaaagcgatt

SEQ ID NO: 982 - DNA, 21 bp, Artificial sequence
  Synthetic sequence: dsRNA targeting HPV E1 Gene Expression. Sense strand (target sequence) having double TT overhang
accauguagucaguauagutt

SEQ ID NO: 983 - DNA, 21 bp, Artificial sequence
  Synthetic sequence: dsRNA targeting HPV E1 Gene Expression. Sense strand (target sequence) having double TT overhang
gaagaggguacgggauguatt

SEQ ID NO: 984 - DNA, 21 bp, Artificial sequence
  Synthetic sequence: dsRNA targeting HPV E1 Gene Expression. Sense strand (target sequence) having double TT overhang
auaaaucaacguguugcgatt

SEQ ID NO: 985 - DNA, 21 bp, Artificial sequence
  Synthetic sequence: dsRNA targeting HPV E1 Gene Expression. Sense strand (target sequence) having double TT overhang
cguguugcgauugguguautt

SEQ ID NO: 986 - DNA, 21 bp, Artificial sequence
  Synthetic sequence: dsRNA targeting HPV E1 Gene Expression. Sense strand (target sequence) having double TT overhang
ugggccuacgauaaugacatt

SEQ ID NO: 987 - DNA, 21 bp, Artificial sequence
  Synthetic sequence: dsRNA targeting HPV E1 Gene Expression. Sense strand (target sequence) having double TT overhang
ugcauauuacuauauggugtt

SEQ ID NO: 988 - DNA, 21 bp, Artificial sequence
  Synthetic sequence: dsRNA targeting HPV E1 Gene Expression. Sense strand (target sequence) having double TT overhang
ccagauuaaguuugcacgatt

SEQ ID NO: 989 - DNA, 21 bp, Artificial sequence
  Synthetic sequence: dsRNA targeting HPV E1 Gene Expression. Sense strand (target sequence) having double TT overhang
agauuauuugaaagcgaagtt

SEQ ID NO: 990 - DNA, 21 bp, Artificial sequence
  Synthetic sequence: dsRNA targeting HPV E1 Gene Expression. Sense strand (target sequence) having double TT overhang
guuacagguagaagggcgctt

SEQ ID NO: 991 - DNA, 21 bp, Artificial sequence
  Synthetic sequence: dsRNA targeting HPV E1 Gene Expression. Sense strand (target sequence) having double TT overhang
gccaaaauagguauguuagtt

SEQ ID NO: 992 - DNA, 21 bp, Artificial sequence
  Synthetic sequence: dsRNA targeting HPV E1 Gene Expression. Sense strand (target sequence) having double TT overhang
gcauagaccauugguacaatt

SEQ ID NO: 993 - DNA, 21 bp, Artificial sequence
  Synthetic sequence: dsRNA targeting HPV E1 Gene Expression. Sense strand (target sequence) having double TT overhang
aaauugcguaguacagcagtt

SEQ ID NO: 994 - DNA, 21 bp, Artificial sequence
  Synthetic sequence: dsRNA targeting HPV E1 Gene Expression. Sense strand (target sequence) having double TT overhang
aguauuuggguaguccacutt

SEQ ID NO: 995 - DNA, 21 bp, Artificial sequence
  Synthetic sequence: dsRNA targeting HPV E1 Gene Expression. Sense strand (target sequence) having double TT overhang
augacauaguagacgauagtt

SEQ ID NO: 996 - DNA, 21 bp, Artificial sequence
  Synthetic sequence: dsRNA targeting HPV E1 Gene Expression. Sense strand (target sequence) having double TT overhang
gguaguccacuuagugauatt

SEQ ID NO: 997 - DNA, 21 bp, Artificial sequence
  Synthetic sequence: dsRNA targeting HPV E1 Gene Expression. Sense strand (target sequence) having double TT overhang
agcauagaccauugguacatt

SEQ ID NO: 998 - DNA, 21 bp, Artificial sequence
  Synthetic sequence: dsRNA targeting HPV E1 Gene Expression. Sense strand (target sequence) having double TT overhang
uuucagaauuaguaagacctt

SEQ ID NO: 999 - DNA, 21 bp, Artificial sequence
  Synthetic sequence: dsRNA targeting HPV E1 Gene Expression. Sense strand (target sequence) having double TT overhang
ugcgauugguguauugcugtt

SEQ ID NO: 1000 - DNA, 21 bp, Artificial sequence
  Synthetic sequence: dsRNA targeting HPV E1 Gene Expression. Sense strand (target sequence) having double TT overhang
ccaaaauugcguaguacagtt

SEQ ID NO: 1001 - DNA, 21 bp, Artificial sequence
  Synthetic sequence: dsRNA targeting HPV E1 Gene Expression. Sense strand (target sequence) having double TT overhang
gacagcacaugcguuguuutt

SEQ ID NO: 1002 - DNA, 21 bp, Artificial sequence
  Synthetic sequence: dsRNA targeting HPV E1 Gene Expression. Sense strand (target sequence) having double TT overhang
uguuacagguagaagggcgtt

SEQ ID NO: 1003 - DNA, 21 bp, Artificial sequence
  Synthetic sequence: dsRNA targeting HPV E1 Gene Expression. Sense strand (target sequence) having double TT overhang
agacaauaauauuaguccutt

SEQ ID NO: 1004 - DNA, 21 bp, Artificial sequence
  Synthetic sequence: dsRNA targeting HPV E1 Gene Expression. Sense strand (target sequence) having double TT overhang
augauuauuuaacacaggctt

SEQ ID NO: 1005 - DNA, 21 bp, Artificial sequence
  Synthetic sequence: dsRNA targeting HPV E1 Gene Expression. Sense strand (target sequence) having double TT overhang
agaugugauaggguagaugtt

SEQ ID NO: 1006 - DNA, 21 bp, Artificial sequence
  Synthetic sequence: dsRNA targeting HPV E1 Gene Expression. Sense strand (target sequence) having double TT overhang
cugcaagggucuguaauautt

SEQ ID NO: 1007 - DNA, 21 bp, Artificial sequence
  Synthetic sequence: dsRNA targeting HPV E1 Gene Expression. Sense strand (target sequence) having double TT overhang
ucagaugacgagaacgaaatt

SEQ ID NO: 1008 - DNA, 21 bp, Artificial sequence
  Synthetic sequence: dsRNA targeting HPV E1 Gene Expression. Sense strand (target sequence) having double TT overhang
caccauguagucaguauagtt

SEQ ID NO: 1009 - DNA, 21 bp, Artificial sequence
  Synthetic sequence: dsRNA targeting HPV E1 Gene Expression. Sense strand (target sequence) having double TT overhang
agacagcacaugcguuguutt

SEQ ID NO: 1010 - DNA, 21 bp, Artificial sequence
  Synthetic sequence: dsRNA targeting HPV E1 Gene Expression. Sense strand (target sequence) having double TT overhang
agaggguacgggauguaautt

SEQ ID NO: 1011 - DNA, 21 bp, Artificial sequence
  Synthetic sequence: dsRNA targeting HPV E1 Gene Expression. Sense strand (target sequence) having double TT overhang
aaaaguaauaaaucaacgutt

SEQ ID NO: 1012 - DNA, 21 bp, Artificial sequence
  Synthetic sequence: dsRNA targeting HPV E1 Gene Expression. Sense strand (target sequence) having double TT overhang
aaagcauagaccauugguatt

SEQ ID NO: 1013 - DNA, 21 bp, Artificial sequence
  Synthetic sequence: dsRNA targeting HPV E1 Gene Expression. Sense strand (target sequence) having double TT overhang
uuguacauuugaauuaucatt

SEQ ID NO: 1014 - DNA, 21 bp, Artificial sequence
  Synthetic sequence: dsRNA targeting HPV E1 Gene Expression. Sense strand (target sequence) having double TT overhang
guaaagcauagaccauuggtt

SEQ ID NO: 1015 - DNA, 21 bp, Artificial sequence
  Synthetic sequence: dsRNA targeting HPV E1 Gene Expression. Sense strand (target sequence) having double TT overhang
  modified_base (4)..(4): um
  modified_base (5)..(5): cm
  modified_base (8)..(8): cm
  modified_base (10)..(10): um
  modified_base (12)..(13): um
  modified_base (15)..(15): cm
  modified_base (18)..(19): um
  misc_feature 20: t is deoxy-thymidine-5prime-phosphorothioate
aaaucaacguguugcgauutt

SEQ ID NO: 1016 - DNA, 21 bp, Artificial sequence
  Synthetic sequence: dsRNA targeting HPV E1 Gene Expression. Sense strand (target sequence) having double TT overhang
  modified_base (4)..(5): cm
  modified_base (6)..(6): um
  modified_base (7)..(8): cm
  modified_base (13)..(14): um
  modified_base (16)..(16): cm
  modified_base (18)..(18): um
  misc_feature 20: t is deoxy-thymidine-5prime-phosphorothioate
gagccuccaaaauugcguatt

SEQ ID NO: 1017 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (2)..(2): cm
  modified_base (5)..(5): cm
  modified_base (7)..(7): um
  modified_base (9)..(10): um
  modified_base (12)..(12): cm
  modified_base (15)..(16): um
  modified_base (19)..(19): um
  misc_feature 20: t is deoxy-thymidine-5prime-phosphorothioate
ucaacguguugcgauuggutt

SEQ ID NO: 1018 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (2)..(3): cm
  modified_base (8)..(9): um
  modified_base (11)..(11): cm
  modified_base (13)..(13): um
  modified_base (16)..(16): um
  modified_base (18)..(18): cm
  misc_feature 20: t is deoxy-thymidine-5prime-phosphorothioate
uccaaaauugcguaguacatt

SEQ ID NO: 1019 - DNA, 21 bp, Artificial sequence
  Synthetic sequence: dsRNA targeting HPV E1 Gene Expression. Sense strand (target sequence) having double TT overhang
  modified_base (3)..(3): um
  modified_base (4)..(4): cm
  modified_base (7)..(7): cm
  modified_base (9)..(9): um
  modified_base (11)..(12): um
  modified_base (14)..(14): cm
  modified_base (17)..(18): um
  misc_feature 20: t is deoxy-thymidine-5prime-phosphorothioate
aaucaacguguugcgauugtt

SEQ ID NO: 1020 - DNA, 21 bp, Artificial sequence
  Synthetic sequence: dsRNA targeting HPV E1 Gene Expression. Sense strand (target sequence) having double TT overhang
  modified_base (1)..(2): cm
  modified_base (3)..(3): um
  modified_base (4)..(5): cm
  modified_base (10)..(11): um
  modified_base (13)..(13): cm
  modified_base (15)..(15): um
  modified_base (18)..(18): um
  misc_feature 20: t is deoxy-thymidine-5prime-phosphorothioate
ccuccaaaauugcguaguatt

SEQ ID NO: 1021 - DNA, 21 bp, Artificial sequence
  Synthetic sequence: dsRNA targeting HPV E1 Gene Expression. Sense strand (target sequence) having double TT overhang
  modified_base (5)..(6): cm
  modified_base (7)..(7): um
  modified_base (8)..(9): cm
  modified_base (14)..(15): um
  modified_base (17)..(17): cm
  modified_base (19)..(19): um
  misc_feature 20: t is deoxy-thymidine-5prime-phosphorothioate
agagccuccaaaauugcgutt

SEQ ID NO: 1022 - DNA, 21 bp, Artificial sequence
  Synthetic sequence: dsRNA targeting HPV E1 Gene Expression. Sense strand (target sequence) having double TT overhang
  modified_base (1)..(1): cm
  modified_base (4)..(4): cm
  modified_base (6)..(6): um
  modified_base (8)..(9): um
  modified_base (11)..(11): cm
  modified_base (14)..(15): um
  modified_base (18)..(18): um
  misc_feature 20: t is deoxy-thymidine-5prime-phosphorothioate
caacguguugcgauuggugtt

SEQ ID NO: 1023 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (6)..(6): um
  modified_base (8)..(8): um
  modified_base (11)..(11): um
  modified_base (16)..(16): um
  misc_feature 20: t is deoxy-thymidine-5prime-phosphorothioate
auagaugugauaggguagatt

SEQ ID NO: 1024 - DNA, 21 bp, Artificial sequence
  Synthetic sequence: dsRNA targeting HPV E1 Gene Expression. Sense strand (target sequence) having double TT overhang
  modified_base (11)..(11): um
  modified_base (13)..(13): cm
  modified_base (18)..(18): um
  misc_feature 20: t is deoxy-thymidine-5prime-phosphorothioate
gggaagaggguacgggaugtt

SEQ ID NO: 1025 - DNA, 21 bp, Artificial sequence
  Synthetic sequence: dsRNA targeting HPV E1 Gene Expression. Sense strand (target sequence) having double TT overhang
  modified_base (4)..(5): um
  modified_base (9)..(11): um
  modified_base (13)..(13): cm
  modified_base (15)..(15): cm
  misc_feature 20: t is deoxy-thymidine-5prime-phosphorothioate
agauuaaguuugcacgaggtt

SEQ ID NO: 1026 - DNA, 21 bp, Artificial sequence
  Synthetic sequence: dsRNA targeting HPV E1 Gene Expression. Sense strand (target sequence) having double TT overhang
  modified_base (3)..(3): um
  modified_base (5)..(5): um
  modified_base (6)..(6): cm
  modified_base (11)..(11): um
  modified_base (13)..(13): um
  modified_base (18)..(19): um
  misc_feature 20: t is deoxy-thymidine-5prime-phosphorothioate
gguaucaagguguagaguutt

SEQ ID NO: 1027 - DNA, 21 bp, Artificial sequence
  Synthetic sequence: dsRNA targeting HPV E1 Gene Expression. Sense strand (target sequence) having double TT overhang
  modified_base (2)..(2): cm
  modified_base (3)..(4): um
  modified_base (7)..(7): um
  modified_base (10)..(10): um
  modified_base (12)..(13): um
  modified_base (16)..(16): um
  misc_feature 20: t is deoxy-thymidine-5prime-phosphorothioate
acuuagugauauuaguggatt

SEQ ID NO: 1028 - DNA, 21 bp, Artificial sequence
  Synthetic sequence: dsRNA targeting HPV E1 Gene Expression. Sense strand (target sequence) having double TT overhang
  modified_base (5)..(6): um
  modified_base (8)..(10): um
  modified_base (16)..(16): cm
  misc_feature 20: t is deoxy-thymidine-5prime-phosphorothioate
gagauuauuugaaagcgaatt

SEQ ID NO: 1029 - DNA, 21 bp, Artificial sequence
  Synthetic sequence: dsRNA targeting HPV E1 Gene Expression. Sense strand (target sequence) having double TT overhang
  modified_base (3)..(3): cm
  modified_base (5)..(6): cm
  modified_base (8)..(8): um
  modified_base (10)..(10): um
  modified_base (13)..(13): um
  modified_base (14)..(14): cm
  modified_base (17)..(17): um
  modified_base (19)..(19): um
  misc_feature 20: t is deoxy-thymidine-5prime-phosphorothioate
aacaccauguagucaguautt

SEQ ID NO: 1030 - DNA, 21 bp, Artificial sequence
  Synthetic sequence: dsRNA targeting HPV E1 Gene Expression. Sense strand (target sequence) having double TT overhang
  modified_base (3)..(4): cm
  modified_base (5)..(5): um
  modified_base (6)..(7): cm
  modified_base (12)..(13): um
  modified_base (15)..(15): cm
  modified_base (17)..(17): um
  misc_feature 20: t is deoxy-thymidine-5prime-phosphorothioate
agccuccaaaauugcguagtt

SEQ ID NO: 1031 - DNA, 21 bp, Artificial sequence
  Synthetic sequence: dsRNA targeting HPV E1 Gene Expression. Sense strand (target sequence) having double TT overhang
  modified_base (2)..(3): cm
  modified_base (4)..(4): um
  modified_base (5)..(6): cm
  modified_base (11)..(12): um
  modified_base (14)..(14): cm
  modified_base (16)..(16): um
  modified_base (19)..(19): um
  misc_feature 20: t is deoxy-thymidine-5prime-phosphorothioate
gccuccaaaauugcguagutt

SEQ ID NO: 1032 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (4)..(4): um
  modified_base (6)..(6): um
  modified_base (12)..(12): cm
  modified_base (14)..(14): cm
  modified_base (16)..(17): cm
  misc_feature 20: t is deoxy-thymidine-5prime-phosphorothioate
guguauggagacacgccagtt

SEQ ID NO: 1033 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (4)..(4): cm
  modified_base (7)..(7): um
  modified_base (11)..(12): cm
  modified_base (13)..(13): um
  modified_base (15)..(15): cm
  modified_base (18)..(18): um
  misc_feature 20: t is deoxy-thymidine-5prime-phosphorothioate
guacaaugggccuacgauatt

SEQ ID NO: 1034 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (3)..(3): cm
  modified_base (6)..(6): um
  modified_base (10)..(11): cm
  modified_base (12)..(12): um
  modified_base (14)..(14): cm
  modified_base (17)..(17): um
  misc_feature 20: t is deoxy-thymidine-5prime-phosphorothioate
uacaaugggccuacgauaatt

SEQ ID NO: 1035 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (4)..(4): cm
  modified_base (6)..(6): um
  modified_base (9)..(9): um
  modified_base (13)..(13): cm
  modified_base (16)..(16): um
  modified_base (19)..(19): um
  misc_feature 20: t is deoxy-thymidine-5prime-phosphorothioate
ugacauaguagacgauagutt

SEQ ID NO: 1036 - DNA, 21 bp, Artificial sequence
  Synthetic sequence: dsRNA targeting HPV E1 Gene Expression. Sense strand (target sequence) having double TT overhang
  modified_base (3)..(3): cm
  modified_base (5)..(5): um
  modified_base (8)..(8): um
  modified_base (12)..(12): cm
  modified_base (15)..(15): um
  modified_base (18)..(18): um
  misc_feature 20: t is deoxy-thymidine-5prime-phosphorothioate
gacauaguagacgauagugtt

SEQ ID NO: 1037 - DNA, 21 bp, Artificial sequence
  Synthetic sequence: dsRNA targeting HPV E1 Gene Expression. Sense strand (target sequence) having double TT overhang
  modified_base (2)..(2): cm
  modified_base (3)..(3): um
  modified_base (4)..(4): cm
  modified_base (5)..(7): um
  modified_base (9)..(10): cm
  modified_base (13)..(13): cm
  modified_base (15)..(17): um
  misc_feature 20: t is deoxy-thymidine-5prime-phosphorothioate
acucuuugccaacguuuaatt

SEQ ID NO: 1038 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (5)..(5): um
  modified_base (8)..(8): cm
  modified_base (10)..(10): um
  modified_base (13)..(13): um
  modified_base (17)..(17): cm
  misc_feature 20: t is deoxy-thymidine-5prime-phosphorothioate
auaaugacauaguagacgatt

SEQ ID NO: 1039 - DNA, 21 bp, Artificial sequence
  Synthetic sequence: dsRNA targeting HPV E1 Gene Expression. Sense strand (target sequence) having double TT overhang
  modified_base (4)..(4): um
  modified_base (6)..(8): um
  modified_base (12)..(12): um
  modified_base (15)..(15): um
  modified_base (16)..(17): cm
  modified_base (19)..(19): cm
  misc_feature 20: t is deoxy-thymidine-5prime-phosphorothioate
aaguauuuggguaguccactt

SEQ ID NO: 1040 - DNA, 21 bp, Artificial sequence
  Synthetic sequence: dsRNA targeting HPV E1 Gene Expression. Sense strand (target sequence) having double TT overhang
  modified_base (2)..(2): cm
  modified_base (4)..(4): um
  modified_base (6)..(7): um
  modified_base (9)..(9): cm
  modified_base (12)..(13): um
  modified_base (16)..(16): um
  modified_base (18)..(18): um
  misc_feature 20: t is deoxy-thymidine-5prime-phosphorothioate
acguguugcgauugguguatt

SEQ ID NO: 1041 - DNA, 21 bp, Artificial sequence
  Synthetic sequence: dsRNA targeting HPV E1 Gene Expression. Sense strand (target sequence) having double TT overhang
  modified_base (1)..(1): cm
  modified_base (7)..(7): um
  modified_base (9)..(11): um
  modified_base (15)..(15): um
  modified_base (18)..(18): um
  modified_base (19)..(19): cm
  misc_feature 20: t is deoxy-thymidine-5prime-phosphorothioate
cgaaaguauuuggguaguctt

SEQ ID NO: 1042 - DNA, 21 bp, Artificial sequence
  Synthetic sequence: dsRNA targeting HPV E1 Gene Expression. Sense strand (target sequence) having double TT overhang
  modified_base (1)..(1): cm
  modified_base (2)..(2): um
  modified_base (3)..(4): cm
  modified_base (9)..(10): um
  modified_base (12)..(12): cm
  modified_base (14)..(14): um
  modified_base (17)..(17): um
  modified_base (19)..(19): cm
  misc_feature 20: t is deoxy-thymidine-5prime-phosphorothioate
cuccaaaauugcguaguactt

SEQ ID NO: 1043 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (4)..(4): um
  modified_base (6)..(6): cm
  modified_base (9)..(9): um
  modified_base (13)..(14): cm
  modified_base (15)..(15): um
  modified_base (17)..(17): cm
  misc_feature 20: t is deoxy-thymidine-5prime-phosphorothioate
ugguacaaugggccuacgatt

SEQ ID NO: 1044 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (4)..(4): um
  modified_base (7)..(7): cm
  modified_base (9)..(9): um
  modified_base (12)..(12): um
  modified_base (16)..(16): cm
  modified_base (19)..(19): um
  misc_feature 20: t is deoxy-thymidine-5prime-phosphorothioate
uaaugacauaguagacgautt

SEQ ID NO: 1045 - DNA, 21 bp, Artificial sequence
  Synthetic sequence: dsRNA targeting HPV E1 Gene Expression. Sense strand (target sequence) having double TT overhang
  modified_base (2)..(2): cm
  modified_base (4)..(4): um
  modified_base (7)..(7): um
  modified_base (11)..(11): cm
  modified_base (14)..(14): um
  modified_base (17)..(17): um
  misc_feature 20: t is deoxy-thymidine-5prime-phosphorothioate
acauaguagacgauagugatt

SEQ ID NO: 1046 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (4)..(4): um
  modified_base (8)..(8): cm
  modified_base (10)..(11): um
  modified_base (13)..(13): um
  modified_base (17)..(17): cm
  misc_feature 20: t is deoxy-thymidine-5prime-phosphorothioate
guguagacauuauaaacgatt

SEQ ID NO: 1047 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (5)..(5): cm
  modified_base (7)..(8): um
  modified_base (10)..(10): um
  modified_base (14)..(14): cm
  modified_base (18)..(18): cm
  misc_feature 20: t is deoxy-thymidine-5prime-phosphorothioate
uagacauuauaaacgagcatt

SEQ ID NO: 1048 - DNA, 21 bp, Artificial sequence
  Synthetic sequence: dsRNA targeting HPV E1 Gene Expression. Sense strand (target sequence) having double TT overhang
  modified_base (1)..(2): um
  modified_base (4)..(4): cm
  modified_base (7)..(8): um
  modified_base (11)..(11): um
  modified_base (13)..(13): um
  modified_base (15)..(16): um
  modified_base (18)..(18): cm
  modified_base (19)..(19): um
  misc_feature 20: t is deoxy-thymidine-5prime-phosphorothioate
uugcgauugguguauugcutt

SEQ ID NO: 1049 - DNA, 21 bp, Artificial sequence
  Synthetic sequence: dsRNA targeting HPV E1 Gene Expression. Sense strand (target sequence) having double TT overhang
  modified_base (1)..(2): um
  modified_base (5)..(5): cm
  modified_base (9)..(9): cm
  modified_base (11)..(11): cm
  modified_base (12)..(12): um
  modified_base (15)..(15): um
  modified_base (18)..(18): um
  misc_feature 20: t is deoxy-thymidine-5prime-phosphorothioate
uuggcagacacuaauaguatt

SEQ ID NO: 1050 - DNA, 21 bp, Artificial sequence
  Synthetic sequence: dsRNA targeting HPV E1 Gene Expression. Sense strand (target sequence) having double TT overhang
  modified_base (1)..(2): um
  modified_base (3)..(3): cm
  modified_base (8)..(9): um
  modified_base (12)..(12): um
  modified_base (17)..(18): cm
  misc_feature 20: t is deoxy-thymidine-5prime-phosphorothioate
uucagaauuaguaagaccatt

SEQ ID NO: 1051 - DNA, 21 bp, Artificial sequence
  Synthetic sequence: dsRNA targeting HPV E1 Gene Expression. Sense strand (target sequence) having double TT overhang
  modified_base (6)..(7): um
  modified_base (9)..(11): um
  modified_base (17)..(17): cm
  misc_feature 20: t is deoxy-thymidine-5prime-phosphorothioate
ggagauuauuugaaagcgatt

SEQ ID NO: 1052 - DNA, 21 bp, Artificial sequence
  Synthetic sequence: dsRNA targeting HPV E1 Gene Expression. Sense strand (target sequence) having double TT overhang
  modified_base (2)..(3): cm
  modified_base (5)..(5): um
  modified_base (7)..(7): um
  modified_base (10)..(10): um
  modified_base (11)..(11): cm
  modified_base (14)..(14): um
  modified_base (16)..(16): um
  modified_base (19)..(19): um
  misc_feature 20: t is deoxy-thymidine-5prime-phosphorothioate
accauguagucaguauagutt

SEQ ID NO: 1053 - DNA, 21 bp, Artificial sequence
  Synthetic sequence: dsRNA targeting HPV E1 Gene Expression. Sense strand (target sequence) having double TT overhang
  modified_base (9)..(9): um
  modified_base (11)..(11): cm
  modified_base (16)..(16): um
  modified_base (18)..(18): um
  misc_feature 20: t is deoxy-thymidine-5prime-phosphorothioate
gaagaggguacgggauguatt

SEQ ID NO: 1054 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (6)..(6): um
  modified_base (7)..(7): cm
  modified_base (10)..(10): cm
  modified_base (12)..(12): um
  modified_base (14)..(15): um
  modified_base (17)..(17): cm
  misc_feature 20: t is deoxy-thymidine-5prime-phosphorothioate
auaaaucaacguguugcgatt

SEQ ID NO: 1055 - DNA, 21 bp, Artificial sequence
  Synthetic sequence: dsRNA targeting HPV E1 Gene Expression. Sense strand (target sequence) having double TT overhang
  modified_base (1)..(1): cm
  modified_base (3)..(3): um
  modified_base (5)..(6): um
  modified_base (8)..(8): cm
  modified_base (11)..(12): um
  modified_base (15)..(15): um
  modified_base (17)..(17): um
  modified_base (19)..(19): um
  misc_feature 20: t is deoxy-thymidine-5prime-phosphorothioate
cguguugcgauugguguautt

SEQ ID NO: 1056 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (5)..(6): cm
  modified_base (7)..(7): um
  modified_base (9)..(9): cm
  modified_base (12)..(12): um
  modified_base (15)..(15): um
  modified_base (18)..(18): cm
  misc_feature 20: t is deoxy-thymidine-5prime-phosphorothioate
ugggccuacgauaaugacatt

SEQ ID NO: 1057 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (3)..(3): cm
  modified_base (5)..(5): um
  modified_base (7)..(8): um
  modified_base (10)..(10): cm
  modified_base (11)..(11): um
  modified_base (13)..(13): um
  modified_base (15)..(15): um
  modified_base (18)..(18): um
  misc_feature 20: t is deoxy-thymidine-5prime-phosphorothioate
ugcauauuacuauauggugtt

SEQ ID NO: 1058 - DNA, 21 bp, Artificial sequence
  Synthetic sequence: dsRNA targeting HPV E1 Gene Expression. Sense strand (target sequence) having double TT overhang
  modified_base (1)..(2): cm
  modified_base (6)..(7): um
  modified_base (11)..(13): um
  modified_base (15)..(15): cm
  modified_base (17)..(17): cm
  misc_feature 20: t is deoxy-thymidine-5prime-phosphorothioate
ccagauuaaguuugcacgatt

SEQ ID NO: 1059 - DNA, 21 bp, Artificial sequence
  Synthetic sequence: dsRNA targeting HPV E1 Gene Expression. Sense strand (target sequence) having double TT overhang
  modified_base (4)..(5): um
  modified_base (7)..(9): um
  modified_base (15)..(15): cm
  misc_feature 20: t is deoxy-thymidine-5prime-phosphorothioate
agauuauuugaaagcgaagtt

SEQ ID NO: 1060 - DNA, 21 bp, Artificial sequence
  Synthetic sequence: dsRNA targeting HPV E1 Gene Expression. Sense strand (target sequence) having double TT overhang
  modified_base (2)..(3): um
  modified_base (5)..(5): cm
  modified_base (9)..(9): um
  modified_base (17)..(17): cm
  modified_base (19)..(19): cm
  misc_feature 20: t is deoxy-thymidine-5prime-phosphorothioate
guuacagguagaagggcgctt

SEQ ID NO: 1061 - DNA, 21 bp, Artificial sequence
  Synthetic sequence: dsRNA targeting HPV E1 Gene Expression. Sense strand (target sequence) having double TT overhang
  modified_base (2)..(3): cm
  modified_base (8)..(8): um
  modified_base (12)..(12): um
  modified_base (14)..(14): um
  modified_base (16)..(17): um
  misc_feature 20: t is deoxy-thymidine-5prime-phosphorothioate
gccaaaauagguauguuagtt

SEQ ID NO: 1062 - DNA, 21 bp, Artificial sequence
  Synthetic sequence: dsRNA targeting HPV E1 Gene Expression. Sense strand (target sequence) having double TT overhang
  modified_base (2)..(2): cm
  modified_base (4)..(4): um
  modified_base (8)..(9): cm
  modified_base (11)..(12): um
  modified_base (15)..(15): um
  modified_base (17)..(17): cm
  misc_feature 20: t is deoxy-thymidine-5prime-phosphorothioate
gcauagaccauugguacaatt

SEQ ID NO: 1063 - DNA, 21 bp, Artificial sequence
  Synthetic sequence: dsRNA targeting HPV E1 Gene Expression. Sense strand (target sequence) having double TT overhang
  modified_base (4)..(5): um
  modified_base (7)..(7): cm
  modified_base (9)..(9): um
  modified_base (12)..(12): um
  modified_base (14)..(14): cm
  modified_base (17)..(17): cm
  misc_feature 20: t is deoxy-thymidine-5prime-phosphorothioate
aaauugcguaguacagcagtt

SEQ ID NO: 1064 - DNA, 21 bp, Artificial sequence
  Synthetic sequence: dsRNA targeting HPV E1 Gene Expression. Sense strand (target sequence) having double TT overhang
  modified_base (3)..(3): um
  modified_base (5)..(7): um
  modified_base (11)..(11): um
  modified_base (14)..(14): um
  modified_base (15)..(16): cm
  modified_base (18)..(18): cm
  modified_base (19)..(19): um
  misc_feature 20: t is deoxy-thymidine-5prime-phosphorothioate
aguauuuggguaguccacutt

SEQ ID NO: 1065 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (5)..(5): cm
  modified_base (7)..(7): um
  modified_base (10)..(10): um
  modified_base (14)..(14): cm
  modified_base (17)..(17): um
  misc_feature 20: t is deoxy-thymidine-5prime-phosphorothioate
augacauaguagacgauagtt

SEQ ID NO: 1066 - DNA, 21 bp, Artificial sequence
  Synthetic sequence: dsRNA targeting HPV E1 Gene Expression. Sense strand (target sequence) having double TT overhang
  modified_base (3)..(3): um
  modified_base (6)..(6): um
  modified_base (7)..(8): cm
  modified_base (10)..(10): cm
  modified_base (11)..(12): um
  modified_base (15)..(15): um
  modified_base (18)..(18): um
  misc_feature 20: t is deoxy-thymidine-5prime-phosphorothioate
gguaguccacuuagugauatt

SEQ ID NO: 1067 - DNA, 21 bp, Artificial sequence
  Synthetic sequence: dsRNA targeting HPV E1 Gene Expression. Sense strand (target sequence) having double TT overhang
  modified_base (3)..(3): cm
  modified_base (5)..(5): um
  modified_base (9)..(10): cm
  modified_base (12)..(13): um
  modified_base (16)..(16): um
  modified_base (18)..(18): cm
  misc_feature 20: t is deoxy-thymidine-5prime-phosphorothioate
agcauagaccauugguacatt

SEQ ID NO: 1068 - DNA, 21 bp, Artificial sequence
  Synthetic sequence: dsRNA targeting HPV E1 Gene Expression. Sense strand (target sequence) having double TT overhang
  modified_base (1)..(3): um
  modified_base (4)..(4): cm
  modified_base (9)..(10): um
  modified_base (13)..(13): um
  modified_base (18)..(19): cm
  misc_feature 20: t is deoxy-thymidine-5prime-phosphorothioate
uuucagaauuaguaagacctt

SEQ ID NO: 1069 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (3)..(3): cm
  modified_base (6)..(7): um
  modified_base (10)..(10): um
  modified_base (12)..(12): um
  modified_base (14)..(15): um
  modified_base (17)..(17): cm
  modified_base (18)..(18): um
  misc_feature 20: t is deoxy-thymidine-5prime-phosphorothioate
ugcgauugguguauugcugtt

SEQ ID NO: 1070 - DNA, 21 bp, Artificial sequence
  Synthetic sequence: dsRNA targeting HPV E1 Gene Expression. Sense strand (target sequence) having double TT overhang
  modified_base (1)..(2): cm
  modified_base (7)..(8): um
  modified_base (10)..(10): cm
  modified_base (12)..(12): um
  modified_base (15)..(15): um
  modified_base (17)..(17): cm
  misc_feature 20: t is deoxy-thymidine-5prime-phosphorothioate
ccaaaauugcguaguacagtt

SEQ ID NO: 1071 - DNA, 21 bp, Artificial sequence
  Synthetic sequence: dsRNA targeting HPV E1 Gene Expression. Sense strand (target sequence) having double TT overhang
  modified_base (3)..(3): cm
  modified_base (6)..(6): cm
  modified_base (8)..(8): cm
  modified_base (10)..(10): um
  modified_base (12)..(12): cm
  modified_base (14)..(15): um
  modified_base (17)..(19): um
  misc_feature 20: t is deoxy-thymidine-5prime-phosphorothioate
gacagcacaugcguuguuutt

SEQ ID NO: 1072 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (3)..(4): um
  modified_base (6)..(6): cm
  modified_base (10)..(10): um
  modified_base (18)..(18): cm
  misc_feature 20: t is deoxy-thymidine-5prime-phosphorothioate
uguuacagguagaagggcgtt

SEQ ID NO: 1073 - DNA, 21 bp, Artificial sequence
  Synthetic sequence: dsRNA targeting HPV E1 Gene Expression. Sense strand (target sequence) having double TT overhang
  modified_base (4)..(4): cm
  modified_base (7)..(7): um
  modified_base (10)..(10): um
  modified_base (12)..(13): um
  modified_base (16)..(16): um
  modified_base (17)..(18): cm
  modified_base (19)..(19): um
  misc_feature 20: t is deoxy-thymidine-5prime-phosphorothioate
agacaauaauauuaguccutt

SEQ ID NO: 1074 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (5)..(6): um
  modified_base (8)..(10): um
  modified_base (13)..(13): cm
  modified_base (15)..(15): cm
  modified_base (19)..(19): cm
  misc_feature 20: t is deoxy-thymidine-5prime-phosphorothioate
augauuauuuaacacaggctt

SEQ ID NO: 1075 - DNA, 21 bp, Artificial sequence
  Synthetic sequence: dsRNA targeting HPV E1 Gene Expression. Sense strand (target sequence) having double TT overhang
  modified_base (4)..(4): um
  modified_base (6)..(6): um
  modified_base (9)..(9): um
  modified_base (14)..(14): um
  modified_base (18)..(18): um
  misc_feature 20: t is deoxy-thymidine-5prime-phosphorothioate
agaugugauaggguagaugtt

SEQ ID NO: 1076 - DNA, 21 bp, Artificial sequence
  Synthetic sequence: dsRNA targeting HPV E1 Gene Expression. Sense strand (target sequence) having double TT overhang
  modified_base (1)..(1): cm
  modified_base (2)..(2): um
  modified_base (4)..(4): cm
  modified_base (10)..(10): um
  modified_base (11)..(11): cm
  modified_base (12)..(12): um
  modified_base (14)..(14): um
  modified_base (17)..(17): um
  modified_base (19)..(19): um
  misc_feature 20: t is deoxy-thymidine-5prime-phosphorothioate
cugcaagggucuguaauautt

SEQ ID NO: 1077 - DNA, 21 bp, Artificial sequence
  Synthetic sequence: dsRNA targeting HPV E1 Gene Expression. Sense strand (target sequence) having double TT overhang
  modified_base (1)..(1): um
  modified_base (2)..(2): cm
  modified_base (6)..(6): um
  modified_base (9)..(9): cm
  modified_base (15)..(15): cm
  misc_feature 20: t is deoxy-thymidine-5prime-phosphorothioate
ucagaugacgagaacgaaatt

SEQ ID NO: 1078 - DNA, 21 bp, Artificial sequence
  Synthetic sequence: dsRNA targeting HPV E1 Gene Expression. Sense strand (target sequence) having double TT overhang
  modified_base (1)..(1): cm
  modified_base (3)..(4): cm
  modified_base (6)..(6): um
  modified_base (8)..(8): um
  modified_base (11)..(11): um
  modified_base (12)..(12): cm
  modified_base (15)..(15): um
  modified_base (17)..(17): um
  misc_feature 20: t is deoxy-thymidine-5prime-phosphorothioate
caccauguagucaguauagtt

SEQ ID NO: 1079 - DNA, 21 bp, Artificial sequence
  Synthetic sequence: dsRNA targeting HPV E1 Gene Expression. Sense strand (target sequence) having double TT overhang
  modified_base (4)..(4): cm
  modified_base (7)..(7): cm
  modified_base (9)..(9): cm
  modified_base (11)..(11): um
  modified_base (13)..(13): cm
  modified_base (15)..(16): um
  modified_base (18)..(19): um
  misc_feature 20: t is deoxy-thymidine-5prime-phosphorothioate
agacagcacaugcguuguutt

SEQ ID NO: 1080 - DNA, 21 bp, Artificial sequence
  Synthetic sequence: dsRNA targeting HPV E1 Gene Expression. Sense strand (target sequence) having double TT overhang
  modified_base (7)..(7): um
  modified_base (9)..(9): cm
  modified_base (14)..(14): um
  modified_base (16)..(16): um
  modified_base (19)..(19): um
  misc_feature 20: t is deoxy-thymidine-5prime-phosphorothioate
agaggguacgggauguaautt

SEQ ID NO: 1081 - DNA, 21 bp, Artificial sequence
  Synthetic sequence: dsRNA targeting HPV E1 Gene Expression. Sense strand (target sequence) having double TT overhang
  modified_base (6)..(6): um
  modified_base (9)..(9): um
  modified_base (13)..(13): um
  modified_base (14)..(14): cm
  modified_base (17)..(17): cm
  modified_base (19)..(19): um
  misc_feature 20: t is deoxy-thymidine-5prime-phosphorothioate
aaaaguaauaaaucaacgutt

SEQ ID NO: 1082 - DNA, 21 bp, Artificial sequence
  Synthetic sequence: dsRNA targeting HPV E1 Gene Expression. Sense strand (target sequence) having double TT overhang
  modified_base (5)..(5): cm
  modified_base (7)..(7): um
  modified_base (11)..(12): cm
  modified_base (14)..(15): um
  modified_base (18)..(18): um
  misc_feature 20: t is deoxy-thymidine-5prime-phosphorothioate
aaagcauagaccauugguatt

SEQ ID NO: 1083 - DNA, 21 bp, Artificial sequence
  Synthetic sequence: dsRNA targeting HPV E1 Gene Expression. Sense strand (target sequence) having double TT overhang
  modified_base (1)..(2): um
  modified_base (4)..(4): um
  modified_base (6)..(6): cm
  modified_base (8)..(10): um
  modified_base (14)..(15): um
  modified_base (17)..(17): um
  modified_base (18)..(18): cm
  misc_feature 20: t is deoxy-thymidine-5prime-phosphorothioate
uuguacauuugaauuaucatt

SEQ ID NO: 1084 - DNA, 21 bp, Artificial sequence
  Synthetic sequence: dsRNA targeting HPV E1 Gene Expression. Sense strand (target sequence) having double TT overhang
  modified_base (2)..(2): um
  modified_base (7)..(7): cm
  modified_base (9)..(9): um
  modified_base (13)..(14): cm
  modified_base (16)..(17): um
  misc_feature 20: t is deoxy-thymidine-5prime-phosphorothioate
guaaagcauagaccauuggtt

SEQ ID NO: 1085 - DNA, 21 bp, Artificial sequence
  Synthetic sequence: dsRNA targeting HPV E1 Gene Expression. Sense strand (target sequence) having double TT overhang
auaucaaauauuagugaagtt

SEQ ID NO: 1086 - DNA, 21 bp, Artificial sequence
  Synthetic sequence: dsRNA targeting HPV E1 Gene Expression. Sense strand (target sequence) having double TT overhang
uaucaaauauuagugaagutt

SEQ ID NO: 1087 - DNA, 21 bp, Artificial sequence
  Synthetic sequence: dsRNA targeting HPV E1 Gene Expression. Sense strand (target sequence) having double TT overhang
ggguauggcaauacugaagtt

SEQ ID NO: 1088 - DNA, 21 bp, Artificial sequence
  Synthetic sequence: dsRNA targeting HPV E1 Gene Expression. Sense strand (target sequence) having double TT overhang
caacguuuaaauguguguctt

SEQ ID NO: 1089 - DNA, 21 bp, Artificial sequence
  Synthetic sequence: dsRNA targeting HPV E1 Gene Expression. Sense strand (target sequence) having double TT overhang
aacguuuaaaugugugucatt

SEQ ID NO: 1090 - DNA, 21 bp, Artificial sequence
  Synthetic sequence: dsRNA targeting HPV E1 Gene Expression. Sense strand (target sequence) having double TT overhang
gaaaacgauggagacucuutt

SEQ ID NO: 1091 - DNA, 21 bp, Artificial sequence
  Synthetic sequence: dsRNA targeting HPV E1 Gene Expression. Sense strand (target sequence) having double TT overhang
gcggguauggcaauacugatt

SEQ ID NO: 1092 - DNA, 21 bp, Artificial sequence
  Synthetic sequence: dsRNA targeting HPV E1 Gene Expression. Sense strand (target sequence) having double TT overhang
cggguauggcaauacugaatt

SEQ ID NO: 1093 - DNA, 21 bp, Artificial sequence
  Synthetic sequence: dsRNA targeting HPV E1 Gene Expression. Sense strand (target sequence) having double TT overhang
uuauaaacgagcagaaaaatt

SEQ ID NO: 1094 - DNA, 21 bp, Artificial sequence
  Synthetic sequence: dsRNA targeting HPV E1 Gene Expression. Sense strand (target sequence) having double TT overhang
acaauguguagacauuauatt

SEQ ID NO: 1095 - DNA, 21 bp, Artificial sequence
  Synthetic sequence: dsRNA targeting HPV E1 Gene Expression. Sense strand (target sequence) having double TT overhang
auuauaaacgagcagaaaatt

SEQ ID NO: 1096 - DNA, 21 bp, Artificial sequence
  Synthetic sequence: dsRNA targeting HPV E1 Gene Expression. Sense strand (target sequence) having double TT overhang
uguguagacauuauaaacgtt

SEQ ID NO: 1097 - DNA, 21 bp, Artificial sequence
  Synthetic sequence: dsRNA targeting HPV E1 Gene Expression. Sense strand (target sequence) having double TT overhang
ugugugucaggacaaaauatt

SEQ ID NO: 1098 - DNA, 21 bp, Artificial sequence
  Synthetic sequence: dsRNA targeting HPV E1 Gene Expression. Sense strand (target sequence) having double TT overhang
acauuauaaacgagcagaatt

SEQ ID NO: 1099 - DNA, 21 bp, Artificial sequence
  Synthetic sequence: dsRNA targeting HPV E1 Gene Expression. Sense strand (target sequence) having double TT overhang
agacagcggguauggcaautt

SEQ ID NO: 1100 - DNA, 21 bp, Artificial sequence
  Synthetic sequence: dsRNA targeting HPV E1 Gene Expression. Sense strand (target sequence) having double TT overhang
gacagcggguauggcaauatt

SEQ ID NO: 1101 - DNA, 21 bp, Artificial sequence
  Synthetic sequence: dsRNA targeting HPV E1 Gene Expression. Sense strand (target sequence) having double TT overhang
acagcggguauggcaauactt

SEQ ID NO: 1102 - DNA, 21 bp, Artificial sequence
  Synthetic sequence: dsRNA targeting HPV E1 Gene Expression. Sense strand (target sequence) having double TT overhang
agcggguauggcaauacugtt

SEQ ID NO: 1103 - DNA, 21 bp, Artificial sequence
  Synthetic sequence: dsRNA targeting HPV E1 Gene Expression. Sense strand (target sequence) having double TT overhang
aacaauguguagacauuautt

SEQ ID NO: 1104 - DNA, 21 bp, Artificial sequence
  Synthetic sequence: dsRNA targeting HPV E1 Gene Expression. Sense strand (target sequence) having double TT overhang
cauuauaaacgagcagaaatt

SEQ ID NO: 1105 - DNA, 21 bp, Artificial sequence
  Synthetic sequence: dsRNA targeting HPV E1 Gene Expression. Sense strand (target sequence) having double TT overhang
acguuuaaaugugugucagtt

SEQ ID NO: 1106 - DNA, 21 bp, Artificial sequence
  Synthetic sequence: dsRNA targeting HPV E1 Gene Expression. Sense strand (target sequence) having double TT overhang
aaaugugugucaggacaaatt

SEQ ID NO: 1107 - DNA, 21 bp, Artificial sequence
  Synthetic sequence: dsRNA targeting HPV E1 Gene Expression. Sense strand (target sequence) having double TT overhang
gguucuaaaacgaaaguautt

SEQ ID NO: 1108 - DNA, 21 bp, Artificial sequence
  Synthetic sequence: dsRNA targeting HPV E1 Gene Expression. Sense strand (target sequence) having double TT overhang
auguguagacauuauaaactt

SEQ ID NO: 1109 - DNA, 21 bp, Artificial sequence
  Synthetic sequence: dsRNA targeting HPV E1 Gene Expression. Sense strand (target sequence) having double TT overhang
aguaagaccauuuaaaagutt

SEQ ID NO: 1110 - DNA, 21 bp, Artificial sequence
  Synthetic sequence: dsRNA targeting HPV E1 Gene Expression. Sense strand (target sequence) having double TT overhang
uaguaagaccauuuaaaagtt

SEQ ID NO: 1111 - DNA, 21 bp, Artificial sequence
  Synthetic sequence: dsRNA targeting HPV E1 Gene Expression. Sense strand (target sequence) having double TT overhang
gaauuaguaagaccauuuatt

SEQ ID NO: 1112 - DNA, 21 bp, Artificial sequence
  Synthetic sequence: dsRNA targeting HPV E1 Gene Expression. Sense strand (target sequence) having double TT overhang
aauuaguaagaccauuuaatt

SEQ ID NO: 1113 - DNA, 21 bp, Artificial sequence
  Synthetic sequence: dsRNA targeting HPV E1 Gene Expression. Sense strand (target sequence) having double TT overhang
auuaguaagaccauuuaaatt

SEQ ID NO: 1114 - DNA, 21 bp, Artificial sequence
  Synthetic sequence: dsRNA targeting HPV E1 Gene Expression. Sense strand (target sequence) having double TT overhang
uuaguaagaccauuuaaaatt

SEQ ID NO: 1115 - DNA, 21 bp, Artificial sequence
  Synthetic sequence: dsRNA targeting HPV E1 Gene Expression. Sense strand (target sequence) having double TT overhang
aauacugaaguggaaacuctt

SEQ ID NO: 1116 - DNA, 21 bp, Artificial sequence
  Synthetic sequence: dsRNA targeting HPV E1 Gene Expression. Sense strand (target sequence) having double TT overhang
auacugaaguggaaacucatt

SEQ ID NO: 1117 - DNA, 21 bp, Artificial sequence
  Synthetic sequence: dsRNA targeting HPV E1 Gene Expression. Sense strand (target sequence) having double TT overhang
caauacugaaguggaaacutt

SEQ ID NO: 1118 - DNA, 21 bp, Artificial sequence
  Synthetic sequence: dsRNA targeting HPV E1 Gene Expression. Sense strand (target sequence) having double TT overhang
uacugaaguggaaacucagtt

SEQ ID NO: 1119 - DNA, 21 bp, Artificial sequence
  Synthetic sequence: dsRNA targeting HPV E1 Gene Expression. Sense strand (target sequence) having double TT overhang
acugaaguggaaacucagctt

SEQ ID NO: 1120 - DNA, 21 bp, Artificial sequence
  Synthetic sequence: dsRNA targeting HPV E1 Gene Expression. Sense strand (target sequence) having double TT overhang
cugaaguggaaacucagcatt

SEQ ID NO: 1121 - DNA, 21 bp, Artificial sequence
  Synthetic sequence: dsRNA targeting HPV E1 Gene Expression. Sense strand (target sequence) having double TT overhang
ugaaguggaaacucagcagtt

SEQ ID NO: 1122 - DNA, 21 bp, Artificial sequence
  Synthetic sequence: dsRNA targeting HPV E1 Gene Expression. Sense strand (target sequence) having double TT overhang
gaaguggaaacucagcagatt

SEQ ID NO: 1123 - DNA, 21 bp, Artificial sequence
  Synthetic sequence: dsRNA targeting HPV E1 Gene Expression. Sense strand (target sequence) having double TT overhang
aaguggaaacucagcagautt

SEQ ID NO: 1124 - DNA, 21 bp, Artificial sequence
  Synthetic sequence: dsRNA targeting HPV E1 Gene Expression. Sense strand (target sequence) having double TT overhang
aguggaaacucagcagaugtt

SEQ ID NO: 1125 - DNA, 21 bp, Artificial sequence
  Synthetic sequence: dsRNA targeting HPV E1 Gene Expression. Sense strand (target sequence) having double TT overhang
auggcaauacugaaguggatt

SEQ ID NO: 1126 - DNA, 21 bp, Artificial sequence
  Synthetic sequence: dsRNA targeting HPV E1 Gene Expression. Sense strand (target sequence) having double TT overhang
aaauccuuuuucucaaggatt

SEQ ID NO: 1127 - DNA, 21 bp, Artificial sequence
  Synthetic sequence: dsRNA targeting HPV E1 Gene Expression. Sense strand (target sequence) having double TT overhang
uccuuuuucucaaggacgutt

SEQ ID NO: 1128 - DNA, 21 bp, Artificial sequence
  Synthetic sequence: dsRNA targeting HPV E1 Gene Expression. Sense strand (target sequence) having double TT overhang
auccuuuuucucaaggacgtt

SEQ ID NO: 1129 - DNA, 21 bp, Artificial sequence
  Synthetic sequence: dsRNA targeting HPV E1 Gene Expression. Sense strand (target sequence) having double TT overhang
ggcaauacugaaguggaaatt

SEQ ID NO: 1130 - DNA, 21 bp, Artificial sequence
  Synthetic sequence: dsRNA targeting HPV E1 Gene Expression. Sense strand (target sequence) having double TT overhang
cuuuuucucaaggacguggtt

SEQ ID NO: 1131 - DNA, 21 bp, Artificial sequence
  Synthetic sequence: dsRNA targeting HPV E1 Gene Expression. Sense strand (target sequence) having double TT overhang
ccuuuuucucaaggacgugtt

SEQ ID NO: 1132 - DNA, 21 bp, Artificial sequence
  Synthetic sequence: dsRNA targeting HPV E1 Gene Expression. Sense strand (target sequence) having double TT overhang
uuuuucucaaggacguggutt

SEQ ID NO: 1133 - DNA, 21 bp, Artificial sequence
  Synthetic sequence: dsRNA targeting HPV E1 Gene Expression. Sense strand (target sequence) having double TT overhang
uggaaauccuuuuucucaatt

SEQ ID NO: 1134 - DNA, 21 bp, Artificial sequence
  Synthetic sequence: dsRNA targeting HPV E1 Gene Expression. Sense strand (target sequence) having double TT overhang
ggaaauccuuuuucucaagtt

SEQ ID NO: 1135 - DNA, 21 bp, Artificial sequence
  Synthetic sequence: dsRNA targeting HPV E1 Gene Expression. Sense strand (target sequence) having double TT overhang
gaaauccuuuuucucaaggtt

SEQ ID NO: 1136 - DNA, 21 bp, Artificial sequence
  Synthetic sequence: dsRNA targeting HPV E1 Gene Expression. Sense strand (target sequence) having double TT overhang
aauccuuuuucucaaggactt

SEQ ID NO: 1137 - DNA, 21 bp, Artificial sequence
  Synthetic sequence: dsRNA targeting HPV E1 Gene Expression. Sense strand (target sequence) having double TT overhang
uauggcaauacugaaguggtt

SEQ ID NO: 1138 - DNA, 21 bp, Artificial sequence
  Synthetic sequence: dsRNA targeting HPV E1 Gene Expression. Sense strand (target sequence) having double TT overhang
uggcaauacugaaguggaatt

SEQ ID NO: 1139 - DNA, 21 bp, Artificial sequence
  Synthetic sequence: dsRNA targeting HPV E1 Gene Expression. Sense strand (target sequence) having double TT overhang
gcaauacugaaguggaaactt

SEQ ID NO: 1140 - DNA, 21 bp, Artificial sequence
  Synthetic sequence: dsRNA targeting HPV E1 Gene Expression. Sense strand (target sequence) having double TT overhang
aauguguagacauuauaaatt

SEQ ID NO: 1141 - DNA, 21 bp, Artificial sequence
  Synthetic sequence: dsRNA targeting HPV E1 Gene Expression. Antisense strand (guide sequence) having double TT overhang
aaucgcaacacguugauuutt

SEQ ID NO: 1142 - DNA, 21 bp, Artificial sequence
  Synthetic sequence: dsRNA targeting HPV E1 Gene Expression. Antisense strand (guide sequence) having double TT overhang
uacgcaauuuuggaggcuctt

SEQ ID NO: 1143 - DNA, 21 bp, Artificial sequence
  Synthetic sequence: dsRNA targeting HPV E1 Gene Expression. Antisense strand (guide sequence) having double TT overhang
accaaucgcaacacguugatt

SEQ ID NO: 1144 - DNA, 21 bp, Artificial sequence
  Synthetic sequence: dsRNA targeting HPV E1 Gene Expression. Antisense strand (guide sequence) having double TT overhang
uguacuacgcaauuuuggatt

SEQ ID NO: 1145 - DNA, 21 bp, Artificial sequence
  Synthetic sequence: dsRNA targeting HPV E1 Gene Expression. Antisense strand (guide sequence) having double TT overhang
caaucgcaacacguugauutt

SEQ ID NO: 1146 - DNA, 21 bp, Artificial sequence
  Synthetic sequence: dsRNA targeting HPV E1 Gene Expression. Antisense strand (guide sequence) having double TT overhang
uacuacgcaauuuuggaggtt

SEQ ID NO: 1147 - DNA, 21 bp, Artificial sequence
  Synthetic sequence: dsRNA targeting HPV E1 Gene Expression. Antisense strand (guide sequence) having double TT overhang
acgcaauuuuggaggcucutt

SEQ ID NO: 1148 - DNA, 21 bp, Artificial sequence
  Synthetic sequence: dsRNA targeting HPV E1 Gene Expression. Antisense strand (guide sequence) having double TT overhang
caccaaucgcaacacguugtt

SEQ ID NO: 1149 - DNA, 21 bp, Artificial sequence
  Synthetic sequence: dsRNA targeting HPV E1 Gene Expression. Antisense strand (guide sequence) having double TT overhang
ucuacccuaucacaucuautt

SEQ ID NO: 1150 - DNA, 21 bp, Artificial sequence
  Synthetic sequence: dsRNA targeting HPV E1 Gene Expression. Antisense strand (guide sequence) having double TT overhang
caucccguacccucuuccctt

SEQ ID NO: 1151 - DNA, 21 bp, Artificial sequence
  Synthetic sequence: dsRNA targeting HPV E1 Gene Expression. Antisense strand (guide sequence) having double TT overhang
ccucgugcaaacuuaaucutt

SEQ ID NO: 1152 - DNA, 21 bp, Artificial sequence
  Synthetic sequence: dsRNA targeting HPV E1 Gene Expression. Antisense strand (guide sequence) having double TT overhang
aacucuacaccuugauacctt

SEQ ID NO: 1153 - DNA, 21 bp, Artificial sequence
  Synthetic sequence: dsRNA targeting HPV E1 Gene Expression. Antisense strand (guide sequence) having double TT overhang
uccacuaauaucacuaagutt

SEQ ID NO: 1154 - DNA, 21 bp, Artificial sequence
  Synthetic sequence: dsRNA targeting HPV E1 Gene Expression. Antisense strand (guide sequence) having double TT overhang
uucgcuuucaaauaaucuctt

SEQ ID NO: 1155 - DNA, 21 bp, Artificial sequence
  Synthetic sequence: dsRNA targeting HPV E1 Gene Expression. Antisense strand (guide sequence) having double TT overhang
auacugacuacaugguguutt

SEQ ID NO: 1156 - DNA, 21 bp, Artificial sequence
  Synthetic sequence: dsRNA targeting HPV E1 Gene Expression. Antisense strand (guide sequence) having double TT overhang
cuacgcaauuuuggaggcutt

SEQ ID NO: 1157 - DNA, 21 bp, Artificial sequence
  Synthetic sequence: dsRNA targeting HPV E1 Gene Expression. Antisense strand (guide sequence) having double TT overhang
acuacgcaauuuuggaggctt

SEQ ID NO: 1158 - DNA, 21 bp, Artificial sequence
  Synthetic sequence: dsRNA targeting HPV E1 Gene Expression. Antisense strand (guide sequence) having double TT overhang
cuggcgugucuccauacactt

SEQ ID NO: 1159 - DNA, 21 bp, Artificial sequence
  Synthetic sequence: dsRNA targeting HPV E1 Gene Expression. Antisense strand (guide sequence) having double TT overhang
uaucguaggcccauuguactt

SEQ ID NO: 1160 - DNA, 21 bp, Artificial sequence
  Synthetic sequence: dsRNA targeting HPV E1 Gene Expression. Antisense strand (guide sequence) having double TT overhang
uuaucguaggcccauuguatt

SEQ ID NO: 1161 - DNA, 21 bp, Artificial sequence
  Synthetic sequence: dsRNA targeting HPV E1 Gene Expression. Antisense strand (guide sequence) having double TT overhang
acuaucgucuacuaugucatt

SEQ ID NO: 1162 - DNA, 21 bp, Artificial sequence
  Synthetic sequence: dsRNA targeting HPV E1 Gene Expression. Antisense strand (guide sequence) having double TT overhang
cacuaucgucuacuauguctt

SEQ ID NO: 1163 - DNA, 21 bp, Artificial sequence
  Synthetic sequence: dsRNA targeting HPV E1 Gene Expression. Antisense strand (guide sequence) having double TT overhang
uuaaacguuggcaaagagutt

SEQ ID NO: 1164 - DNA, 21 bp, Artificial sequence
  Synthetic sequence: dsRNA targeting HPV E1 Gene Expression. Antisense strand (guide sequence) having double TT overhang
ucgucuacuaugucauuautt

SEQ ID NO: 1165 - DNA, 21 bp, Artificial sequence
  Synthetic sequence: dsRNA targeting HPV E1 Gene Expression. Antisense strand (guide sequence) having double TT overhang
guggacuacccaaauacuutt

SEQ ID NO: 1166 - DNA, 21 bp, Artificial sequence
  Synthetic sequence: dsRNA targeting HPV E1 Gene Expression. Antisense strand (guide sequence) having double TT overhang
uacaccaaucgcaacacgutt

SEQ ID NO: 1167 - DNA, 21 bp, Artificial sequence
  Synthetic sequence: dsRNA targeting HPV E1 Gene Expression. Antisense strand (guide sequence) having double TT overhang
gacuacccaaauacuuucgtt

SEQ ID NO: 1168 - DNA, 21 bp, Artificial sequence
  Synthetic sequence: dsRNA targeting HPV E1 Gene Expression. Antisense strand (guide sequence) having double TT overhang
guacuacgcaauuuuggagtt

SEQ ID NO: 1169 - DNA, 21 bp, Artificial sequence
  Synthetic sequence: dsRNA targeting HPV E1 Gene Expression. Antisense strand (guide sequence) having double TT overhang
ucguaggcccauuguaccatt

SEQ ID NO: 1170 - DNA, 21 bp, Artificial sequence
  Synthetic sequence: dsRNA targeting HPV E1 Gene Expression. Antisense strand (guide sequence) having double TT overhang
aucgucuacuaugucauuatt

SEQ ID NO: 1171 - DNA, 21 bp, Artificial sequence
  Synthetic sequence: dsRNA targeting HPV E1 Gene Expression. Antisense strand (guide sequence) having double TT overhang
ucacuaucgucuacuaugutt

SEQ ID NO: 1172 - DNA, 21 bp, Artificial sequence
  Synthetic sequence: dsRNA targeting HPV E1 Gene Expression. Antisense strand (guide sequence) having double TT overhang
ucguuuauaaugucuacactt

SEQ ID NO: 1173 - DNA, 21 bp, Artificial sequence
  Synthetic sequence: dsRNA targeting HPV E1 Gene Expression. Antisense strand (guide sequence) having double TT overhang
ugcucguuuauaaugucuatt

SEQ ID NO: 1174 - DNA, 21 bp, Artificial sequence
  Synthetic sequence: dsRNA targeting HPV E1 Gene Expression. Antisense strand (guide sequence) having double TT overhang
agcaauacaccaaucgcaatt

SEQ ID NO: 1175 - DNA, 21 bp, Artificial sequence
  Synthetic sequence: dsRNA targeting HPV E1 Gene Expression. Antisense strand (guide sequence) having double TT overhang
uacuauuagugucugccaatt

SEQ ID NO: 1176 - DNA, 21 bp, Artificial sequence
  Synthetic sequence: dsRNA targeting HPV E1 Gene Expression. Antisense strand (guide sequence) having double TT overhang
uggucuuacuaauucugaatt

SEQ ID NO: 1177 - DNA, 21 bp, Artificial sequence
  Synthetic sequence: dsRNA targeting HPV E1 Gene Expression. Antisense strand (guide sequence) having double TT overhang
ucgcuuucaaauaaucucctt

SEQ ID NO: 1178 - DNA, 21 bp, Artificial sequence
  Synthetic sequence: dsRNA targeting HPV E1 Gene Expression. Antisense strand (guide sequence) having double TT overhang
acuauacugacuacauggutt

SEQ ID NO: 1179 - DNA, 21 bp, Artificial sequence
  Synthetic sequence: dsRNA targeting HPV E1 Gene Expression. Antisense strand (guide sequence) having double TT overhang
uacaucccguacccucuuctt

SEQ ID NO: 1180 - DNA, 21 bp, Artificial sequence
  Synthetic sequence: dsRNA targeting HPV E1 Gene Expression. Antisense strand (guide sequence) having double TT overhang
ucgcaacacguugauuuautt

SEQ ID NO: 1181 - DNA, 21 bp, Artificial sequence
  Synthetic sequence: dsRNA targeting HPV E1 Gene Expression. Antisense strand (guide sequence) having double TT overhang
auacaccaaucgcaacacgtt

SEQ ID NO: 1182 - DNA, 21 bp, Artificial sequence
  Synthetic sequence: dsRNA targeting HPV E1 Gene Expression. Antisense strand (guide sequence) having double TT overhang
ugucauuaucguaggcccatt

SEQ ID NO: 1183 - DNA, 21 bp, Artificial sequence
  Synthetic sequence: dsRNA targeting HPV E1 Gene Expression. Antisense strand (guide sequence) having double TT overhang
caccauauaguaauaugcatt

SEQ ID NO: 1184 - DNA, 21 bp, Artificial sequence
  Synthetic sequence: dsRNA targeting HPV E1 Gene Expression. Antisense strand (guide sequence) having double TT overhang
ucgugcaaacuuaaucuggtt

SEQ ID NO: 1185 - DNA, 21 bp, Artificial sequence
  Synthetic sequence: dsRNA targeting HPV E1 Gene Expression. Antisense strand (guide sequence) having double TT overhang
cuucgcuuucaaauaaucutt

SEQ ID NO: 1186 - DNA, 21 bp, Artificial sequence
  Synthetic sequence: dsRNA targeting HPV E1 Gene Expression. Antisense strand (guide sequence) having double TT overhang
gcgcccuucuaccuguaactt

SEQ ID NO: 1187 - DNA, 21 bp, Artificial sequence
  Synthetic sequence: dsRNA targeting HPV E1 Gene Expression. Antisense strand (guide sequence) having double TT overhang
cuaacauaccuauuuuggctt

SEQ ID NO: 1188 - DNA, 21 bp, Artificial sequence
  Synthetic sequence: dsRNA targeting HPV E1 Gene Expression. Antisense strand (guide sequence) having double TT overhang
uuguaccaauggucuaugctt

SEQ ID NO: 1189 - DNA, 21 bp, Artificial sequence
  Synthetic sequence: dsRNA targeting HPV E1 Gene Expression. Antisense strand (guide sequence) having double TT overhang
cugcuguacuacgcaauuutt

SEQ ID NO: 1190 - DNA, 21 bp, Artificial sequence
  Synthetic sequence: dsRNA targeting HPV E1 Gene Expression. Antisense strand (guide sequence) having double TT overhang
aguggacuacccaaauacutt

SEQ ID NO: 1191 - DNA, 21 bp, Artificial sequence
  Synthetic sequence: dsRNA targeting HPV E1 Gene Expression. Antisense strand (guide sequence) having double TT overhang
cuaucgucuacuaugucautt

SEQ ID NO: 1192 - DNA, 21 bp, Artificial sequence
  Synthetic sequence: dsRNA targeting HPV E1 Gene Expression. Antisense strand (guide sequence) having double TT overhang
uaucacuaaguggacuacctt

SEQ ID NO: 1193 - DNA, 21 bp, Artificial sequence
  Synthetic sequence: dsRNA targeting HPV E1 Gene Expression. Antisense strand (guide sequence) having double TT overhang
uguaccaauggucuaugcutt

SEQ ID NO: 1194 - DNA, 21 bp, Artificial sequence
  Synthetic sequence: dsRNA targeting HPV E1 Gene Expression. Antisense strand (guide sequence) having double TT overhang
ggucuuacuaauucugaaatt

SEQ ID NO: 1195 - DNA, 21 bp, Artificial sequence
  Synthetic sequence: dsRNA targeting HPV E1 Gene Expression. Antisense strand (guide sequence) having double TT overhang
cagcaauacaccaaucgcatt

SEQ ID NO: 1196 - DNA, 21 bp, Artificial sequence
  Synthetic sequence: dsRNA targeting HPV E1 Gene Expression. Antisense strand (guide sequence) having double TT overhang
cuguacuacgcaauuuuggtt

SEQ ID NO: 1197 - DNA, 21 bp, Artificial sequence
  Synthetic sequence: dsRNA targeting HPV E1 Gene Expression. Antisense strand (guide sequence) having double TT overhang
aaacaacgcaugugcuguctt

SEQ ID NO: 1198 - DNA, 21 bp, Artificial sequence
  Synthetic sequence: dsRNA targeting HPV E1 Gene Expression. Antisense strand (guide sequence) having double TT overhang
cgcccuucuaccuguaacatt

SEQ ID NO: 1199 - DNA, 21 bp, Artificial sequence
  Synthetic sequence: dsRNA targeting HPV E1 Gene Expression. Antisense strand (guide sequence) having double TT overhang
aggacuaauauuauugucutt

SEQ ID NO: 1200 - DNA, 21 bp, Artificial sequence
  Synthetic sequence: dsRNA targeting HPV E1 Gene Expression. Antisense strand (guide sequence) having double TT overhang
gccuguguuaaauaaucautt

SEQ ID NO: 1201 - DNA, 21 bp, Artificial sequence
  Synthetic sequence: dsRNA targeting HPV E1 Gene Expression. Antisense strand (guide sequence) having double TT overhang
caucuacccuaucacaucutt

SEQ ID NO: 1202 - DNA, 21 bp, Artificial sequence
  Synthetic sequence: dsRNA targeting HPV E1 Gene Expression. Antisense strand (guide sequence) having double TT overhang
auauuacagacccuugcagtt

SEQ ID NO: 1203 - DNA, 21 bp, Artificial sequence
  Synthetic sequence: dsRNA targeting HPV E1 Gene Expression. Antisense strand (guide sequence) having double TT overhang
uuucguucucgucaucugatt

SEQ ID NO: 1204 - DNA, 21 bp, Artificial sequence
  Synthetic sequence: dsRNA targeting HPV E1 Gene Expression. Antisense strand (guide sequence) having double TT overhang
cuauacugacuacauggugtt

SEQ ID NO: 1205 - DNA, 21 bp, Artificial sequence
  Synthetic sequence: dsRNA targeting HPV E1 Gene Expression. Antisense strand (guide sequence) having double TT overhang
aacaacgcaugugcugucutt

SEQ ID NO: 1206 - DNA, 21 bp, Artificial sequence
  Synthetic sequence: dsRNA targeting HPV E1 Gene Expression. Antisense strand (guide sequence) having double TT overhang
auuacaucccguacccucutt

SEQ ID NO: 1207 - DNA, 21 bp, Artificial sequence
  Synthetic sequence: dsRNA targeting HPV E1 Gene Expression. Antisense strand (guide sequence) having double TT overhang
acguugauuuauuacuuuutt

SEQ ID NO: 1208 - DNA, 21 bp, Artificial sequence
  Synthetic sequence: dsRNA targeting HPV E1 Gene Expression. Antisense strand (guide sequence) having double TT overhang
uaccaauggucuaugcuuutt

SEQ ID NO: 1209 - DNA, 21 bp, Artificial sequence
  Synthetic sequence: dsRNA targeting HPV E1 Gene Expression. Antisense strand (guide sequence) having double TT overhang
ugauaauucaaauguacaatt

SEQ ID NO: 1210 - DNA, 21 bp, Artificial sequence
  Synthetic sequence: dsRNA targeting HPV E1 Gene Expression. Antisense strand (guide sequence) having double TT overhang
ccaauggucuaugcuuuactt

SEQ ID NO: 1211 - DNA, 21 bp, Artificial sequence
  Synthetic sequence: dsRNA targeting HPV E1 Gene Expression. Antisense strand (guide sequence) having double TT overhang
  modified_base (6)..(6): cm
  modified_base (9)..(9): cm
  misc_feature 20: t is deoxy-thymidine-5prime-phosphorothioate
aaucgcaacacguugauuutt

SEQ ID NO: 1212 - DNA, 21 bp, Artificial sequence
  Synthetic sequence: dsRNA targeting HPV E1 Gene Expression. Antisense strand (guide sequence) having double TT overhang
  modified_base (1)..(1): um
  modified_base (5)..(5): cm
  misc_feature 20: t is deoxy-thymidine-5prime-phosphorothioate
uacgcaauuuuggaggcuctt

SEQ ID NO: 1213 - DNA, 21 bp, Artificial sequence
  Synthetic sequence: dsRNA targeting HPV E1 Gene Expression. Antisense strand (guide sequence) having double TT overhang
  modified_base (3)..(3): cm
  modified_base (9)..(9): cm
  modified_base (12)..(12): cm
  misc_feature 20: t is deoxy-thymidine-5prime-phosphorothioate
accaaucgcaacacguugatt

SEQ ID NO: 1214 - DNA, 21 bp, Artificial sequence
  Synthetic sequence: dsRNA targeting HPV E1 Gene Expression. Antisense strand (guide sequence) having double TT overhang
  modified_base (3)..(3): um
  modified_base (6)..(6): um
  modified_base (10)..(10): cm
  misc_feature 20: t is deoxy-thymidine-5prime-phosphorothioate
uguacuacgcaauuuuggatt

SEQ ID NO: 1215 - DNA, 21 bp, Artificial sequence
  Synthetic sequence: dsRNA targeting HPV E1 Gene Expression. Antisense strand (guide sequence) having double TT overhang
  modified_base (1)..(1): cm
  modified_base (7)..(7): cm
  modified_base (10)..(10): cm
  misc_feature 20: t is deoxy-thymidine-5prime-phosphorothioate
caaucgcaacacguugauutt

SEQ ID NO: 1216 - DNA, 21 bp, Artificial sequence
  Synthetic sequence: dsRNA targeting HPV E1 Gene Expression. Antisense strand (guide sequence) having double TT overhang
  modified_base (1)..(1): um
  modified_base (4)..(4): um
  modified_base (8)..(8): cm
  misc_feature 20: t is deoxy-thymidine-5prime-phosphorothioate
uacuacgcaauuuuggaggtt

SEQ ID NO: 1217 - DNA, 21 bp, Artificial sequence
  Synthetic sequence: dsRNA targeting HPV E1 Gene Expression. Antisense strand (guide sequence) having double TT overhang
  modified_base (4)..(4): cm
  misc_feature 20: t is deoxy-thymidine-5prime-phosphorothioate
acgcaauuuuggaggcucutt

SEQ ID NO: 1218 - DNA, 21 bp, Artificial sequence
  Synthetic sequence: dsRNA targeting HPV E1 Gene Expression. Antisense strand (guide sequence) having double TT overhang
  modified_base (1)..(1): cm
  modified_base (4)..(4): cm
  modified_base (10)..(10): cm
  modified_base (13)..(13): cm
  misc_feature 20: t is deoxy-thymidine-5prime-phosphorothioate
caccaaucgcaacacguugtt

SEQ ID NO: 1219 - DNA, 21 bp, Artificial sequence
  Synthetic sequence: dsRNA targeting HPV E1 Gene Expression. Antisense strand (guide sequence) having double TT overhang
  modified_base (3)..(3): um
  modified_base (8)..(8): um
  modified_base (11)..(11): cm
  modified_base (13)..(13): cm
  modified_base (17)..(17): um
  misc_feature 20: t is deoxy-thymidine-5prime-phosphorothioate
ucuacccuaucacaucuautt

SEQ ID NO: 1220 - DNA, 21 bp, Artificial sequence
  Synthetic sequence: dsRNA targeting HPV E1 Gene Expression. Antisense strand (guide sequence) having double TT overhang
  modified_base (1)..(1): cm
  modified_base (8)..(8): um
  misc_feature 20: t is deoxy-thymidine-5prime-phosphorothioate
caucccguacccucuuccctt

SEQ ID NO: 1221 - DNA, 21 bp, Artificial sequence
  Synthetic sequence: dsRNA targeting HPV E1 Gene Expression. Antisense strand (guide sequence) having double TT overhang
  modified_base (8)..(8): cm
  modified_base (14)..(14): um
  misc_feature 20: t is deoxy-thymidine-5prime-phosphorothioate
ccucgugcaaacuuaaucutt

SEQ ID NO: 1222 - DNA, 21 bp, Artificial sequence
  Synthetic sequence: dsRNA targeting HPV E1 Gene Expression. Antisense strand (guide sequence) having double TT overhang
  modified_base (6)..(6): um
  modified_base (8)..(8): cm
  modified_base (16)..(16): um
  misc_feature 20: t is deoxy-thymidine-5prime-phosphorothioate
aacucuacaccuugauacctt

SEQ ID NO: 1223 - DNA, 21 bp, Artificial sequence
  Synthetic sequence: dsRNA targeting HPV E1 Gene Expression. Antisense strand (guide sequence) having double TT overhang
  modified_base (3)..(3): cm
  modified_base (6)..(6): um
  modified_base (9)..(9): um
  modified_base (12)..(12): cm
  modified_base (15)..(15): um
  misc_feature 20: t is deoxy-thymidine-5prime-phosphorothioate
uccacuaauaucacuaagutt

SEQ ID NO: 1224 - DNA, 21 bp, Artificial sequence
  Synthetic sequence: dsRNA targeting HPV E1 Gene Expression. Antisense strand (guide sequence) having double TT overhang
  modified_base (9)..(9): cm
  modified_base (13)..(13): um
  misc_feature 20: t is deoxy-thymidine-5prime-phosphorothioate
uucgcuuucaaauaaucuctt

SEQ ID NO: 1225 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (9)..(9): um
  modified_base (11)..(11): cm
  misc_feature 20: t is deoxy-thymidine-5prime-phosphorothioate
auacugacuacaugguguutt

SEQ ID NO: 1226 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (6)..(6): cm
  misc_feature 20: t is deoxy-thymidine-5prime-phosphorothioate
cuacgcaauuuuggaggcutt

SEQ ID NO: 1227 - DNA, 21 bp, Artificial sequence
  Synthetic sequence: dsRNA targeting HPV E1 Gene Expression. Antisense strand (guide sequence) having double TT overhang
  modified_base (3)..(3): um
  modified_base (7)..(7): cm
  misc_feature 20: t is deoxy-thymidine-5prime-phosphorothioate
acuacgcaauuuuggaggctt

SEQ ID NO: 1228 - DNA, 21 bp, Artificial sequence
  Synthetic sequence: dsRNA targeting HPV E1 Gene Expression. Antisense strand (guide sequence) having double TT overhang
  modified_base (13)..(13): cm
  modified_base (15)..(15): um
  modified_base (17)..(17): cm
  misc_feature 20: t is deoxy-thymidine-5prime-phosphorothioate
cuggcgugucuccauacactt

SEQ ID NO: 1229 - DNA, 21 bp, Artificial sequence
  Synthetic sequence: dsRNA targeting HPV E1 Gene Expression. Antisense strand (guide sequence) having double TT overhang
  modified_base (1)..(1): um
  modified_base (6)..(6): um
  modified_base (12)..(12): cm
  modified_base (17)..(17): um
  misc_feature 20: t is deoxy-thymidine-5prime-phosphorothioate
uaucguaggcccauuguactt

SEQ ID NO: 1230 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (7)..(7): um
  modified_base (13)..(13): cm
  modified_base (18)..(18): um
  misc_feature 20: t is deoxy-thymidine-5prime-phosphorothioate
uuaucguaggcccauuguatt

SEQ ID NO: 1231 - DNA, 21 bp, Artificial sequence
  Synthetic sequence: dsRNA targeting HPV E1 Gene Expression. Antisense strand (guide sequence) having double TT overhang
  modified_base (3)..(3): um
  modified_base (10)..(10): um
  modified_base (13)..(13): um
  modified_base (18)..(18): cm
  misc_feature 20: t is deoxy-thymidine-5prime-phosphorothioate
acuaucgucuacuaugucatt

SEQ ID NO: 1232 - DNA, 21 bp, Artificial sequence
  Synthetic sequence: dsRNA targeting HPV E1 Gene Expression. Antisense strand (guide sequence) having double TT overhang
  modified_base (1)..(1): cm
  modified_base (4)..(4): um
  modified_base (11)..(11): um
  modified_base (14)..(14): um
  misc_feature 20: t is deoxy-thymidine-5prime-phosphorothioate
cacuaucgucuacuauguctt

SEQ ID NO: 1233 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (12)..(12): cm
  misc_feature 20: t is deoxy-thymidine-5prime-phosphorothioate
uuaaacguuggcaaagagutt

SEQ ID NO: 1234 - DNA, 21 bp, Artificial sequence
  Synthetic sequence: dsRNA targeting HPV E1 Gene Expression. Antisense strand (guide sequence) having double TT overhang
  modified_base (6)..(6): um
  modified_base (9)..(9): um
  modified_base (14)..(14): cm
  modified_base (17)..(17): um
  misc_feature 20: t is deoxy-thymidine-5prime-phosphorothioate
ucgucuacuaugucauuautt

SEQ ID NO: 1235 - DNA, 21 bp, Artificial sequence
  Synthetic sequence: dsRNA targeting HPV E1 Gene Expression. Antisense strand (guide sequence) having double TT overhang
  modified_base (7)..(7): um
  modified_base (11)..(11): cm
  modified_base (15)..(15): um
  misc_feature 20: t is deoxy-thymidine-5prime-phosphorothioate
guggacuacccaaauacuutt

SEQ ID NO: 1236 - DNA, 21 bp, Artificial sequence
  Synthetic sequence: dsRNA targeting HPV E1 Gene Expression. Antisense strand (guide sequence) having double TT overhang
  modified_base (1)..(1): um
  modified_base (3)..(3): cm
  modified_base (6)..(6): cm
  modified_base (12)..(12): cm
  modified_base (15)..(15): cm
  misc_feature 20: t is deoxy-thymidine-5prime-phosphorothioate
uacaccaaucgcaacacgutt

SEQ ID NO: 1237 - DNA, 21 bp, Artificial sequence
  Synthetic sequence: dsRNA targeting HPV E1 Gene Expression. Antisense strand (guide sequence) having double TT overhang
  modified_base (4)..(4): um
  modified_base (8)..(8): cm
  modified_base (12)..(12): um
  misc_feature 20: t is deoxy-thymidine-5prime-phosphorothioate
gacuacccaaauacuuucgtt

SEQ ID NO: 1238 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (5)..(5): um
  modified_base (9)..(9): cm
  misc_feature 20: t is deoxy-thymidine-5prime-phosphorothioate
guacuacgcaauuuuggagtt

SEQ ID NO: 1239 - DNA, 21 bp, Artificial sequence
  Synthetic sequence: dsRNA targeting HPV E1 Gene Expression. Antisense strand (guide sequence) having double TT overhang
  modified_base (4)..(4): um
  modified_base (10)..(10): cm
  modified_base (15)..(15): um
  modified_base (18)..(18): cm
  misc_feature 20: t is deoxy-thymidine-5prime-phosphorothioate
ucguaggcccauuguaccatt

SEQ ID NO: 1240 - DNA, 21 bp, Artificial sequence
  Synthetic sequence: dsRNA targeting HPV E1 Gene Expression. Antisense strand (guide sequence) having double TT overhang
  modified_base (7)..(7): um
  modified_base (10)..(10): um
  modified_base (15)..(15): cm
  modified_base (18)..(18): um
  misc_feature 20: t is deoxy-thymidine-5prime-phosphorothioate
aucgucuacuaugucauuatt

SEQ ID NO: 1241 - DNA, 21 bp, Artificial sequence
  Synthetic sequence: dsRNA targeting HPV E1 Gene Expression. Antisense strand (guide sequence) having double TT overhang
  modified_base (2)..(2): cm
  modified_base (5)..(5): um
  modified_base (12)..(12): um
  modified_base (15)..(15): um
  misc_feature 20: t is deoxy-thymidine-5prime-phosphorothioate
ucacuaucgucuacuaugutt

SEQ ID NO: 1242 - DNA, 21 bp, Artificial sequence
  Synthetic sequence: dsRNA targeting HPV E1 Gene Expression. Antisense strand (guide sequence) having double TT overhang
  modified_base (6)..(6): um
  modified_base (8)..(8): um
  modified_base (15)..(15): um
  modified_base (17)..(17): cm
  misc_feature 20: t is deoxy-thymidine-5prime-phosphorothioate
ucguuuauaaugucuacactt

SEQ ID NO: 1243 - DNA, 21 bp, Artificial sequence
  Synthetic sequence: dsRNA targeting HPV E1 Gene Expression. Antisense strand (guide sequence) having double TT overhang
  modified_base (9)..(9): um
  modified_base (11)..(11): um
  modified_base (18)..(18): um
  misc_feature 20: t is deoxy-thymidine-5prime-phosphorothioate
ugcucguuuauaaugucuatt

SEQ ID NO: 1244 - DNA, 21 bp, Artificial sequence
  Synthetic sequence: dsRNA targeting HPV E1 Gene Expression. Antisense strand (guide sequence) having double TT overhang
  modified_base (3)..(3): cm
  modified_base (6)..(6): um
  modified_base (8)..(8): cm
  modified_base (11)..(11): cm
  modified_base (17)..(17): cm
  misc_feature 20: t is deoxy-thymidine-5prime-phosphorothioate
agcaauacaccaaucgcaatt

SEQ ID NO: 1245 - DNA, 21 bp, Artificial sequence
  Synthetic sequence: dsRNA targeting HPV E1 Gene Expression. Antisense strand (guide sequence) having double TT overhang
  modified_base (1)..(1): um
  modified_base (4)..(4): um
  modified_base (7)..(7): um
  modified_base (17)..(17): cm
  misc_feature 20: t is deoxy-thymidine-5prime-phosphorothioate
uacuauuagugucugccaatt

SEQ ID NO: 1246 - DNA, 21 bp, Artificial sequence
  Synthetic sequence: dsRNA targeting HPV E1 Gene Expression. Antisense strand (guide sequence) having double TT overhang
  modified_base (7)..(7): um
  modified_base (10)..(10): um
  misc_feature 20: t is deoxy-thymidine-5prime-phosphorothioate
uggucuuacuaauucugaatt

SEQ ID NO: 1247 - DNA, 21 bp, Artificial sequence
  Synthetic sequence: dsRNA targeting HPV E1 Gene Expression. Antisense strand (guide sequence) having double TT overhang
  modified_base (8)..(8): cm
  modified_base (12)..(12): um
  misc_feature 20: t is deoxy-thymidine-5prime-phosphorothioate
ucgcuuucaaauaaucucctt

SEQ ID NO: 1248 - DNA, 21 bp, Artificial sequence
  Synthetic sequence: dsRNA targeting HPV E1 Gene Expression. Antisense strand (guide sequence) having double TT overhang
  modified_base (3)..(3): um
  modified_base (5)..(5): um
  modified_base (12)..(12): um
  modified_base (14)..(14): cm
  misc_feature 20: t is deoxy-thymidine-5prime-phosphorothioate
acuauacugacuacauggutt

SEQ ID NO: 1249 - DNA, 21 bp, Artificial sequence
  Synthetic sequence: dsRNA targeting HPV E1 Gene Expression. Antisense strand (guide sequence) having double TT overhang
  modified_base (1)..(1): um
  modified_base (3)..(3): cm
  modified_base (10)..(10): um
  misc_feature 20: t is deoxy-thymidine-5prime-phosphorothioate
uacaucccguacccucuuctt

SEQ ID NO: 1250 - DNA, 21 bp, Artificial sequence
  Synthetic sequence: dsRNA targeting HPV E1 Gene Expression. Antisense strand (guide sequence) having double TT overhang
  modified_base (4)..(4): cm
  modified_base (7)..(7): cm
  modified_base (17)..(17): um
  misc_feature 20: t is deoxy-thymidine-5prime-phosphorothioate
ucgcaacacguugauuuautt

SEQ ID NO: 1251 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (4)..(4): cm
  modified_base (7)..(7): cm
  modified_base (13)..(13): cm
  modified_base (16)..(16): cm
  misc_feature 20: t is deoxy-thymidine-5prime-phosphorothioate
auacaccaaucgcaacacgtt

SEQ ID NO: 1252 - DNA, 21 bp, Artificial sequence
  Synthetic sequence: dsRNA targeting HPV E1 Gene Expression. Antisense strand (guide sequence) having double TT overhang
  modified_base (4)..(4): cm
  modified_base (7)..(7): um
  modified_base (12)..(12): um
  modified_base (18)..(18): cm
  misc_feature 20: t is deoxy-thymidine-5prime-phosphorothioate
ugucauuaucguaggcccatt

SEQ ID NO: 1253 - DNA, 21 bp, Artificial sequence
  Synthetic sequence: dsRNA targeting HPV E1 Gene Expression. Antisense strand (guide sequence) having double TT overhang
  modified_base (1)..(1): cm
  modified_base (4)..(4): cm
  modified_base (6)..(6): um
  modified_base (8)..(8): um
  modified_base (11)..(11): um
  modified_base (14)..(14): um
  modified_base (18)..(18): cm
  misc_feature 20: t is deoxy-thymidine-5prime-phosphorothioate
caccauauaguaauaugcatt

SEQ ID NO: 1254 - DNA, 21 bp, Artificial sequence
  Synthetic sequence: dsRNA targeting HPV E1 Gene Expression. Antisense strand (guide sequence) having double TT overhang
  modified_base (6)..(6): cm
  modified_base (12)..(12): um
  misc_feature 20: t is deoxy-thymidine-5prime-phosphorothioate
ucgugcaaacuuaaucuggtt

SEQ ID NO: 1255 - DNA, 21 bp, Artificial sequence
  Synthetic sequence: dsRNA targeting HPV E1 Gene Expression. Antisense strand (guide sequence) having double TT overhang
  modified_base (10)..(10): cm
  modified_base (14)..(14): um
  misc_feature 20: t is deoxy-thymidine-5prime-phosphorothioate
cuucgcuuucaaauaaucutt

SEQ ID NO: 1256 - DNA, 21 bp, Artificial sequence
  Synthetic sequence: dsRNA targeting HPV E1 Gene Expression. Antisense strand (guide sequence) having double TT overhang
  modified_base (10)..(10): um
  modified_base (16)..(16): um
  misc_feature 20: t is deoxy-thymidine-5prime-phosphorothioate
gcgcccuucuaccuguaactt

SEQ ID NO: 1257 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (5)..(5): cm
  modified_base (7)..(7): um
  modified_base (11)..(11): um
  misc_feature 20: t is deoxy-thymidine-5prime-phosphorothioate
cuaacauaccuauuuuggctt

SEQ ID NO: 1258 - DNA, 21 bp, Artificial sequence
  Synthetic sequence: dsRNA targeting HPV E1 Gene Expression. Antisense strand (guide sequence) having double TT overhang
  modified_base (4)..(4): um
  modified_base (7)..(7): cm
  modified_base (15)..(15): um
  misc_feature 20: t is deoxy-thymidine-5prime-phosphorothioate
uuguaccaauggucuaugctt

SEQ ID NO: 1259 - DNA, 21 bp, Artificial sequence
  Synthetic sequence: dsRNA targeting HPV E1 Gene Expression. Antisense strand (guide sequence) having double TT overhang
  modified_base (7)..(7): um
  modified_base (10)..(10): um
  modified_base (14)..(14): cm
  misc_feature 20: t is deoxy-thymidine-5prime-phosphorothioate
cugcuguacuacgcaauuutt

SEQ ID NO: 1260 - DNA, 21 bp, Artificial sequence
  Synthetic sequence: dsRNA targeting HPV E1 Gene Expression. Antisense strand (guide sequence) having double TT overhang
  modified_base (8)..(8): um
  modified_base (12)..(12): cm
  modified_base (16)..(16): um
  misc_feature 20: t is deoxy-thymidine-5prime-phosphorothioate
aguggacuacccaaauacutt

SEQ ID NO: 1261 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (9)..(9): um
  modified_base (12)..(12): um
  modified_base (17)..(17): cm
  misc_feature 20: t is deoxy-thymidine-5prime-phosphorothioate
cuaucgucuacuaugucautt

SEQ ID NO: 1262 - DNA, 21 bp, Artificial sequence
  Synthetic sequence: dsRNA targeting HPV E1 Gene Expression. Antisense strand (guide sequence) having double TT overhang
  modified_base (1)..(1): um
  modified_base (4)..(4): cm
  modified_base (7)..(7): um
  modified_base (16)..(16): um
  misc_feature 20: t is deoxy-thymidine-5prime-phosphorothioate
uaucacuaaguggacuacctt

SEQ ID NO: 1263 - DNA, 21 bp, Artificial sequence
  Synthetic sequence: dsRNA targeting HPV E1 Gene Expression. Antisense strand (guide sequence) having double TT overhang
  modified_base (3)..(3): um
  modified_base (6)..(6): cm
  modified_base (14)..(14): um
  misc_feature 20: t is deoxy-thymidine-5prime-phosphorothioate
uguaccaauggucuaugcutt

SEQ ID NO: 1264 - DNA, 21 bp, Artificial sequence
  Synthetic sequence: dsRNA targeting HPV E1 Gene Expression. Antisense strand (guide sequence) having double TT overhang
  modified_base (6)..(6): um
  modified_base (9)..(9): um
  misc_feature 20: t is deoxy-thymidine-5prime-phosphorothioate
ggucuuacuaauucugaaatt

SEQ ID NO: 1265 - DNA, 21 bp, Artificial sequence
  Synthetic sequence: dsRNA targeting HPV E1 Gene Expression. Antisense strand (guide sequence) having double TT overhang
  modified_base (1)..(1): cm
  modified_base (4)..(4): cm
  modified_base (7)..(7): um
  modified_base (9)..(9): cm
  modified_base (12)..(12): cm
  modified_base (18)..(18): cm
  misc_feature 20: t is deoxy-thymidine-5prime-phosphorothioate
cagcaauacaccaaucgcatt

SEQ ID NO: 1266 - DNA, 21 bp, Artificial sequence
  Synthetic sequence: dsRNA targeting HPV E1 Gene Expression. Antisense strand (guide sequence) having double TT overhang
  modified_base (4)..(4): um
  modified_base (7)..(7): um
  modified_base (11)..(11): cm
  misc_feature 20: t is deoxy-thymidine-5prime-phosphorothioate
cuguacuacgcaauuuuggtt

SEQ ID NO: 1267 - DNA, 21 bp, Artificial sequence
  Synthetic sequence: dsRNA targeting HPV E1 Gene Expression. Antisense strand (guide sequence) having double TT overhang
  modified_base (4)..(4): cm
  modified_base (9)..(9): cm
  misc_feature 20: t is deoxy-thymidine-5prime-phosphorothioate
aaacaacgcaugugcuguctt

SEQ ID NO: 1268 - DNA, 21 bp, Artificial sequence
  Synthetic sequence: dsRNA targeting HPV E1 Gene Expression. Antisense strand (guide sequence) having double TT overhang
  modified_base (9)..(9): um
  modified_base (15)..(15): um
  modified_base (18)..(18): cm
  misc_feature 20: t is deoxy-thymidine-5prime-phosphorothioate
cgcccuucuaccuguaacatt

SEQ ID NO: 1269 - DNA, 21 bp, Artificial sequence
  Synthetic sequence: dsRNA targeting HPV E1 Gene Expression. Antisense strand (guide sequence) having double TT overhang
  modified_base (6)..(6): um
  modified_base (9)..(9): um
  modified_base (12)..(12): um
  misc_feature 20: t is deoxy-thymidine-5prime-phosphorothioate
aggacuaauauuauugucutt

SEQ ID NO: 1270 - DNA, 21 bp, Artificial sequence
  Synthetic sequence: dsRNA targeting HPV E1 Gene Expression. Antisense strand (guide sequence) having double TT overhang
  modified_base (9)..(9): um
  modified_base (13)..(13): um
  modified_base (17)..(17): cm
  misc_feature 20: t is deoxy-thymidine-5prime-phosphorothioate
gccuguguuaaauaaucautt

SEQ ID NO: 1271 - DNA, 21 bp, Artificial sequence
  Synthetic sequence: dsRNA targeting HPV E1 Gene Expression. Antisense strand (guide sequence) having double TT overhang
  modified_base (1)..(1): cm
  modified_base (5)..(5): um
  modified_base (10)..(10): um
  modified_base (13)..(13): cm
  modified_base (15)..(15): cm
  misc_feature 20: t is deoxy-thymidine-5prime-phosphorothioate
caucuacccuaucacaucutt

SEQ ID NO: 1272 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (5)..(5): um
  modified_base (7)..(7): cm
  modified_base (17)..(17): cm
  misc_feature 20: t is deoxy-thymidine-5prime-phosphorothioate
auauuacagacccuugcagtt

SEQ ID NO: 1273 - DNA, 21 bp, Artificial sequence
  Synthetic sequence: dsRNA targeting HPV E1 Gene Expression. Antisense strand (guide sequence) having double TT overhang
  modified_base (13)..(13): cm
  misc_feature 20: t is deoxy-thymidine-5prime-phosphorothioate
uuucguucucgucaucugatt

SEQ ID NO: 1274 - DNA, 21 bp, Artificial sequence
  Synthetic sequence: dsRNA targeting HPV E1 Gene Expression. Antisense strand (guide sequence) having double TT overhang
  modified_base (2)..(2): um
  modified_base (4)..(4): um
  modified_base (11)..(11): um
  modified_base (13)..(13): cm
  misc_feature 20: t is deoxy-thymidine-5prime-phosphorothioate
cuauacugacuacauggugtt

SEQ ID NO: 1275 - DNA, 21 bp, Artificial sequence
  Synthetic sequence: dsRNA targeting HPV E1 Gene Expression. Antisense strand (guide sequence) having double TT overhang
  modified_base (3)..(3): cm
  modified_base (8)..(8): cm
  misc_feature 20: t is deoxy-thymidine-5prime-phosphorothioate
aacaacgcaugugcugucutt

SEQ ID NO: 1276 - DNA, 21 bp, Artificial sequence
  Synthetic sequence: dsRNA targeting HPV E1 Gene Expression. Antisense strand (guide sequence) having double TT overhang
  modified_base (3)..(3): um
  modified_base (5)..(5): cm
  modified_base (12)..(12): um
  misc_feature 20: t is deoxy-thymidine-5prime-phosphorothioate
auuacaucccguacccucutt

SEQ ID NO: 1277 - DNA, 21 bp, Artificial sequence
  Synthetic sequence: dsRNA targeting HPV E1 Gene Expression. Antisense strand (guide sequence) having double TT overhang
  modified_base (10)..(10): um
  modified_base (13)..(13): um
  misc_feature 20: t is deoxy-thymidine-5prime-phosphorothioate
acguugauuuauuacuuuutt

SEQ ID NO: 1278 - DNA, 21 bp, Artificial sequence
  Synthetic sequence: dsRNA targeting HPV E1 Gene Expression. Antisense strand (guide sequence) having double TT overhang
  modified_base (1)..(1): um
  modified_base (4)..(4): cm
  modified_base (12)..(12): um
  misc_feature 20: t is deoxy-thymidine-5prime-phosphorothioate
uaccaauggucuaugcuuutt

SEQ ID NO: 1279 - DNA, 21 bp, Artificial sequence
  Synthetic sequence: dsRNA targeting HPV E1 Gene Expression. Antisense strand (guide sequence) having double TT overhang
  modified_base (4)..(4): um
  modified_base (9)..(9): cm
  modified_base (15)..(15): um
  modified_base (17)..(17): cm
  misc_feature 20: t is deoxy-thymidine-5prime-phosphorothioate
ugauaauucaaauguacaatt

SEQ ID NO: 1280 - DNA, 21 bp, Artificial sequence
  Synthetic sequence: dsRNA targeting HPV E1 Gene Expression. Antisense strand (guide sequence) having double TT overhang
  modified_base (2)..(2): cm
  modified_base (10)..(10): um
  modified_base (17)..(17): um
  misc_feature 20: t is deoxy-thymidine-5prime-phosphorothioate
ccaauggucuaugcuuuactt

SEQ ID NO: 1281 - DNA, 21 bp, Artificial sequence
  Synthetic sequence: dsRNA targeting HPV E1 Gene Expression. Antisense strand (guide sequence) having double TT overhang
cuucacuaauauuugauautt

SEQ ID NO: 1282 - DNA, 21 bp, Artificial sequence
  Synthetic sequence: dsRNA targeting HPV E1 Gene Expression. Antisense strand (guide sequence) having double TT overhang
acuucacuaauauuugauatt

SEQ ID NO: 1283 - DNA, 21 bp, Artificial sequence
  Synthetic sequence: dsRNA targeting HPV E1 Gene Expression. Antisense strand (guide sequence) having double TT overhang
cuucaguauugccauaccctt

SEQ ID NO: 1284 - DNA, 21 bp, Artificial sequence
  Synthetic sequence: dsRNA targeting HPV E1 Gene Expression. Antisense strand (guide sequence) having double TT overhang
gacacacauuuaaacguugtt

SEQ ID NO: 1285 - DNA, 21 bp, Artificial sequence
  Synthetic sequence: dsRNA targeting HPV E1 Gene Expression. Antisense strand (guide sequence) having double TT overhang
ugacacacauuuaaacguutt

SEQ ID NO: 1286 - DNA, 21 bp, Artificial sequence
  Synthetic sequence: dsRNA targeting HPV E1 Gene Expression. Antisense strand (guide sequence) having double TT overhang
aagagucuccaucguuuuctt

SEQ ID NO: 1287 - DNA, 21 bp, Artificial sequence
  Synthetic sequence: dsRNA targeting HPV E1 Gene Expression. Antisense strand (guide sequence) having double TT overhang
ucaguauugccauacccgctt

SEQ ID NO: 1288 - DNA, 21 bp, Artificial sequence
  Synthetic sequence: dsRNA targeting HPV E1 Gene Expression. Antisense strand (guide sequence) having double TT overhang
uucaguauugccauacccgtt

SEQ ID NO: 1289 - DNA, 21 bp, Artificial sequence
  Synthetic sequence: dsRNA targeting HPV E1 Gene Expression. Antisense strand (guide sequence) having double TT overhang
uuuuucugcucguuuauaatt

SEQ ID NO: 1290 - DNA, 21 bp, Artificial sequence
  Synthetic sequence: dsRNA targeting HPV E1 Gene Expression. Antisense strand (guide sequence) having double TT overhang
uauaaugucuacacauugutt

SEQ ID NO: 1291 - DNA, 21 bp, Artificial sequence
  Synthetic sequence: dsRNA targeting HPV E1 Gene Expression. Antisense strand (guide sequence) having double TT overhang
uuuucugcucguuuauaautt

SEQ ID NO: 1292 - DNA, 21 bp, Artificial sequence
  Synthetic sequence: dsRNA targeting HPV E1 Gene Expression. Antisense strand (guide sequence) having double TT overhang
cguuuauaaugucuacacatt

SEQ ID NO: 1293 - DNA, 21 bp, Artificial sequence
  Synthetic sequence: dsRNA targeting HPV E1 Gene Expression. Antisense strand (guide sequence) having double TT overhang
uauuuuguccugacacacatt

SEQ ID NO: 1294 - DNA, 21 bp, Artificial sequence
  Synthetic sequence: dsRNA targeting HPV E1 Gene Expression. Antisense strand (guide sequence) having double TT overhang
uucugcucguuuauaaugutt

SEQ ID NO: 1295 - DNA, 21 bp, Artificial sequence
  Synthetic sequence: dsRNA targeting HPV E1 Gene Expression. Antisense strand (guide sequence) having double TT overhang
auugccauacccgcugucutt

SEQ ID NO: 1296 - DNA, 21 bp, Artificial sequence
  Synthetic sequence: dsRNA targeting HPV E1 Gene Expression. Antisense strand (guide sequence) having double TT overhang
uauugccauacccgcuguctt

SEQ ID NO: 1297 - DNA, 21 bp, Artificial sequence
  Synthetic sequence: dsRNA targeting HPV E1 Gene Expression. Antisense strand (guide sequence) having double TT overhang
guauugccauacccgcugutt

SEQ ID NO: 1298 - DNA, 21 bp, Artificial sequence
  Synthetic sequence: dsRNA targeting HPV E1 Gene Expression. Antisense strand (guide sequence) having double TT overhang
caguauugccauacccgcutt

SEQ ID NO: 1299 - DNA, 21 bp, Artificial sequence
  Synthetic sequence: dsRNA targeting HPV E1 Gene Expression. Antisense strand (guide sequence) having double TT overhang
auaaugucuacacauuguutt

SEQ ID NO: 1300 - DNA, 21 bp, Artificial sequence
  Synthetic sequence: dsRNA targeting HPV E1 Gene Expression. Antisense strand (guide sequence) having double TT overhang
uuucugcucguuuauaaugtt

SEQ ID NO: 1301 - DNA, 21 bp, Artificial sequence
  Synthetic sequence: dsRNA targeting HPV E1 Gene Expression. Antisense strand (guide sequence) having double TT overhang
cugacacacauuuaaacgutt

SEQ ID NO: 1302 - DNA, 21 bp, Artificial sequence
  Synthetic sequence: dsRNA targeting HPV E1 Gene Expression. Antisense strand (guide sequence) having double TT overhang
uuuguccugacacacauuutt

SEQ ID NO: 1303 - DNA, 21 bp, Artificial sequence
  Synthetic sequence: dsRNA targeting HPV E1 Gene Expression. Antisense strand (guide sequence) having double TT overhang
auacuuucguuuuagaacctt

SEQ ID NO: 1304 - DNA, 21 bp, Artificial sequence
  Synthetic sequence: dsRNA targeting HPV E1 Gene Expression. Antisense strand (guide sequence) having double TT overhang
guuuauaaugucuacacautt

SEQ ID NO: 1305 - DNA, 21 bp, Artificial sequence
  Synthetic sequence: dsRNA targeting HPV E1 Gene Expression. Antisense strand (guide sequence) having double TT overhang
acuuuuaaauggucuuacutt

SEQ ID NO: 1306 - DNA, 21 bp, Artificial sequence
  Synthetic sequence: dsRNA targeting HPV E1 Gene Expression. Antisense strand (guide sequence) having double TT overhang
cuuuuaaauggucuuacuatt

SEQ ID NO: 1307 - DNA, 21 bp, Artificial sequence
  Synthetic sequence: dsRNA targeting HPV E1 Gene Expression. Antisense strand (guide sequence) having double TT overhang
uaaauggucuuacuaauuctt

SEQ ID NO: 1308 - DNA, 21 bp, Artificial sequence
  Synthetic sequence: dsRNA targeting HPV E1 Gene Expression. Antisense strand (guide sequence) having double TT overhang
uuaaauggucuuacuaauutt

SEQ ID NO: 1309 - DNA, 21 bp, Artificial sequence
  Synthetic sequence: dsRNA targeting HPV E1 Gene Expression. Antisense strand (guide sequence) having double TT overhang
uuuaaauggucuuacuaautt

SEQ ID NO: 1310 - DNA, 21 bp, Artificial sequence
  Synthetic sequence: dsRNA targeting HPV E1 Gene Expression. Antisense strand (guide sequence) having double TT overhang
uuuuaaauggucuuacuaatt

SEQ ID NO: 1311 - DNA, 21 bp, Artificial sequence
  Synthetic sequence: dsRNA targeting HPV E1 Gene Expression. Antisense strand (guide sequence) having double TT overhang
gaguuuccacuucaguauutt

SEQ ID NO: 1312 - DNA, 21 bp, Artificial sequence
  Synthetic sequence: dsRNA targeting HPV E1 Gene Expression. Antisense strand (guide sequence) having double TT overhang
ugaguuuccacuucaguautt

SEQ ID NO: 1313 - DNA, 21 bp, Artificial sequence
  Synthetic sequence: dsRNA targeting HPV E1 Gene Expression. Antisense strand (guide sequence) having double TT overhang
aguuuccacuucaguauugtt

SEQ ID NO: 1314 - DNA, 21 bp, Artificial sequence
  Synthetic sequence: dsRNA targeting HPV E1 Gene Expression. Antisense strand (guide sequence) having double TT overhang
cugaguuuccacuucaguatt

SEQ ID NO: 1315 - DNA, 21 bp, Artificial sequence
  Synthetic sequence: dsRNA targeting HPV E1 Gene Expression. Antisense strand (guide sequence) having double TT overhang
gcugaguuuccacuucagutt

SEQ ID NO: 1316 - DNA, 21 bp, Artificial sequence
  Synthetic sequence: dsRNA targeting HPV E1 Gene Expression. Antisense strand (guide sequence) having double TT overhang
ugcugaguuuccacuucagtt

SEQ ID NO: 1317 - DNA, 21 bp, Artificial sequence
  Synthetic sequence: dsRNA targeting HPV E1 Gene Expression. Antisense strand (guide sequence) having double TT overhang
cugcugaguuuccacuucatt

SEQ ID NO: 1318 - DNA, 21 bp, Artificial sequence
  Synthetic sequence: dsRNA targeting HPV E1 Gene Expression. Antisense strand (guide sequence) having double TT overhang
ucugcugaguuuccacuuctt

SEQ ID NO: 1319 - DNA, 21 bp, Artificial sequence
  Synthetic sequence: dsRNA targeting HPV E1 Gene Expression. Antisense strand (guide sequence) having double TT overhang
aucugcugaguuuccacuutt

SEQ ID NO: 1320 - DNA, 21 bp, Artificial sequence
  Synthetic sequence: dsRNA targeting HPV E1 Gene Expression. Antisense strand (guide sequence) having double TT overhang
caucugcugaguuuccacutt

SEQ ID NO: 1321 - DNA, 21 bp, Artificial sequence
  Synthetic sequence: dsRNA targeting HPV E1 Gene Expression. Antisense strand (guide sequence) having double TT overhang
uccacuucaguauugccautt

SEQ ID NO: 1322 - DNA, 21 bp, Artificial sequence
  Synthetic sequence: dsRNA targeting HPV E1 Gene Expression. Antisense strand (guide sequence) having double TT overhang
uccuugagaaaaaggauuutt

SEQ ID NO: 1323 - DNA, 21 bp, Artificial sequence
  Synthetic sequence: dsRNA targeting HPV E1 Gene Expression. Antisense strand (guide sequence) having double TT overhang
acguccuugagaaaaaggatt

SEQ ID NO: 1324 - DNA, 21 bp, Artificial sequence
  Synthetic sequence: dsRNA targeting HPV E1 Gene Expression. Antisense strand (guide sequence) having double TT overhang
cguccuugagaaaaaggautt

SEQ ID NO: 1325 - DNA, 21 bp, Artificial sequence
  Synthetic sequence: dsRNA targeting HPV E1 Gene Expression. Antisense strand (guide sequence) having double TT overhang
uuuccacuucaguauugcctt

SEQ ID NO: 1326 - DNA, 21 bp, Artificial sequence
  Synthetic sequence: dsRNA targeting HPV E1 Gene Expression. Antisense strand (guide sequence) having double TT overhang
ccacguccuugagaaaaagtt

SEQ ID NO: 1327 - DNA, 21 bp, Artificial sequence
  Synthetic sequence: dsRNA targeting HPV E1 Gene Expression. Antisense strand (guide sequence) having double TT overhang
cacguccuugagaaaaaggtt

SEQ ID NO: 1328 - DNA, 21 bp, Artificial sequence
  Synthetic sequence: dsRNA targeting HPV E1 Gene Expression. Antisense strand (guide sequence) having double TT overhang
accacguccuugagaaaaatt

SEQ ID NO: 1329 - DNA, 21 bp, Artificial sequence
  Synthetic sequence: dsRNA targeting HPV E1 Gene Expression. Antisense strand (guide sequence) having double TT overhang
uugagaaaaaggauuuccatt

SEQ ID NO: 1330 - DNA, 21 bp, Artificial sequence
  Synthetic sequence: dsRNA targeting HPV E1 Gene Expression. Antisense strand (guide sequence) having double TT overhang
cuugagaaaaaggauuucctt

SEQ ID NO: 1331 - DNA, 21 bp, Artificial sequence
  Synthetic sequence: dsRNA targeting HPV E1 Gene Expression. Antisense strand (guide sequence) having double TT overhang
ccuugagaaaaaggauuuctt

SEQ ID NO: 1332 - DNA, 21 bp, Artificial sequence
  Synthetic sequence: dsRNA targeting HPV E1 Gene Expression. Antisense strand (guide sequence) having double TT overhang
guccuugagaaaaaggauutt

SEQ ID NO: 1333 - DNA, 21 bp, Artificial sequence
  Synthetic sequence: dsRNA targeting HPV E1 Gene Expression. Antisense strand (guide sequence) having double TT overhang
ccacuucaguauugccauatt

SEQ ID NO: 1334 - DNA, 21 bp, Artificial sequence
  Synthetic sequence: dsRNA targeting HPV E1 Gene Expression. Antisense strand (guide sequence) having double TT overhang
uuccacuucaguauugccatt

SEQ ID NO: 1335 - DNA, 21 bp, Artificial sequence
  Synthetic sequence: dsRNA targeting HPV E1 Gene Expression. Antisense strand (guide sequence) having double TT overhang
guuuccacuucaguauugctt

SEQ ID NO: 1336 - DNA, 21 bp, Artificial sequence
  Synthetic sequence: dsRNA targeting HPV E1 Gene Expression. Antisense strand (guide sequence) having double TT overhang
uuuauaaugucuacacauutt

SEQ ID NO: 1337 - RNA, 23 nt, Artificial sequence
  Synthetic sequence: Target sequence of mRNA from HPV E6 reference sequence (sequence of total 19mer target site + aa at both ends)
aaggucgguggaccggucgauaa

SEQ ID NO: 1338 - RNA, 23 nt, Artificial sequence
  Synthetic sequence: Target sequence of mRNA from HPV E6 reference sequence (sequence of total 19mer target site + aa at both ends)
aacgguggaccggucgauguaaa

SEQ ID NO: 1339 - RNA, 23 nt, Artificial sequence
  Synthetic sequence: Target sequence of mRNA from HPV E6 reference sequence (sequence of total 19mer target site + aa at both ends)
aagucgguggaccggucgaugaa

SEQ ID NO: 1340 - RNA, 23 nt, Artificial sequence
  Synthetic sequence: Target sequence of mRNA from HPV E6 reference sequence (sequence of total 19mer target site + aa at both ends)
aaaucaucaagaacacguagaaa

SEQ ID NO: 1341 - RNA, 23 nt, Artificial sequence
  Synthetic sequence: Target sequence of mRNA from HPV E6 reference sequence (sequence of total 19mer target site + aa at both ends)
aacaacaguuacugcgacgugaa

SEQ ID NO: 1342 - RNA, 23 nt, Artificial sequence
  Synthetic sequence: Target sequence of mRNA from HPV E6 reference sequence (sequence of total 19mer target site + aa at both ends)
aacaauacaacaaaccguuguaa

SEQ ID NO: 1343 - RNA, 23 nt, Artificial sequence
  Synthetic sequence: Target sequence of mRNA from HPV E6 reference sequence (sequence of total 19mer target site + aa at both ends)
aagcugcaaacaacuauacauaa

SEQ ID NO: 1344 - RNA, 23 nt, Artificial sequence
  Synthetic sequence: Target sequence of mRNA from HPV E6 reference sequence (sequence of total 19mer target site + aa at both ends)
aagguggaccggucgauguauaa

SEQ ID NO: 1345 - RNA, 23 nt, Artificial sequence
  Synthetic sequence: Target sequence of mRNA from HPV E6 reference sequence (sequence of total 19mer target site + aa at both ends)
aaaaauuagugaguauagacaaa

SEQ ID NO: 1346 - RNA, 23 nt, Artificial sequence
  Synthetic sequence: Target sequence of mRNA from HPV E6 reference sequence (sequence of total 19mer target site + aa at both ends)
aaucaucaagaacacguagagaa

SEQ ID NO: 1347 - RNA, 23 nt, Artificial sequence
  Synthetic sequence: Target sequence of mRNA from HPV E6 reference sequence (sequence of total 19mer target site + aa at both ends)
aaauacaacaaaccguuguguaa

SEQ ID NO: 1348 - RNA, 23 nt, Artificial sequence
  Synthetic sequence: Target sequence of mRNA from HPV E6 reference sequence (sequence of total 19mer target site + aa at both ends)
aauggaccggucgauguauguaa

SEQ ID NO: 1349 - RNA, 23 nt, Artificial sequence
  Synthetic sequence: Target sequence of mRNA from HPV E6 reference sequence (sequence of total 19mer target site + aa at both ends)
aauacaacaaaccguugugugaa

SEQ ID NO: 1350 - RNA, 23 nt, Artificial sequence
  Synthetic sequence: Target sequence of mRNA from HPV E6 reference sequence (sequence of total 19mer target site + aa at both ends)
aaagauuccauaauauaagggaa

SEQ ID NO: 1351 - RNA, 23 nt, Artificial sequence
  Synthetic sequence: Target sequence of mRNA from HPV E6 reference sequence (sequence of total 19mer target site + aa at both ends)
aacaagcaacaguuacugcgaaa

SEQ ID NO: 1352 - RNA, 23 nt, Artificial sequence
  Synthetic sequence: Target sequence of mRNA from HPV E6 reference sequence (sequence of total 19mer target site + aa at both ends)
aaguuaauuagguguauuaacaa

SEQ ID NO: 1353 - RNA, 23 nt, Artificial sequence
  Synthetic sequence: Target sequence of mRNA from HPV E6 reference sequence (sequence of total 19mer target site + aa at both ends)
aauuugcuuuucgggauuuauaa

SEQ ID NO: 1354 - RNA, 23 nt, Artificial sequence
  Synthetic sequence: Target sequence of mRNA from HPV E6 reference sequence (sequence of total 19mer target site + aa at both ends)
aaacuuugcuuuucgggauuuaa

SEQ ID NO: 1355 - RNA, 23 nt, Artificial sequence
  Synthetic sequence: Target sequence of mRNA from HPV E6 reference sequence (sequence of total 19mer target site + aa at both ends)
aacugcaaacaacuauacaugaa

SEQ ID NO: 1356 - RNA, 23 nt, Artificial sequence
  Synthetic sequence: Target sequence of mRNA from HPV E6 reference sequence (sequence of total 19mer target site + aa at both ends)
aaaugacuuugcuuuucgggaaa

SEQ ID NO: 1357 - RNA, 23 nt, Artificial sequence
  Synthetic sequence: Target sequence of mRNA from HPV E6 reference sequence (sequence of total 19mer target site + aa at both ends)
aacgacccagaaaguuaccacaa

SEQ ID NO: 1358 - RNA, 23 nt, Artificial sequence
  Synthetic sequence: Target sequence of mRNA from HPV E6 reference sequence (sequence of total 19mer target site + aa at both ends)
aauuacugcgacgugagguauaa

SEQ ID NO: 1359 - RNA, 23 nt, Artificial sequence
  Synthetic sequence: Target sequence of mRNA from HPV E6 reference sequence (sequence of total 19mer target site + aa at both ends)
aaguuacugcgacgugagguaaa

SEQ ID NO: 1360 - RNA, 23 nt, Artificial sequence
  Synthetic sequence: Target sequence of mRNA from HPV E6 reference sequence (sequence of total 19mer target site + aa at both ends)
aaugcgacgugagguauaugaaa

SEQ ID NO: 1361 - RNA, 23 nt, Artificial sequence
  Synthetic sequence: Target sequence of mRNA from HPV E6 reference sequence (sequence of total 19mer target site + aa at both ends)
aagucgauguaugucuuguugaa

SEQ ID NO: 1362 - RNA, 23 nt, Artificial sequence
  Synthetic sequence: Target sequence of mRNA from HPV E6 reference sequence (sequence of total 19mer target site + aa at both ends)
aacgacgugagguauaugacuaa

SEQ ID NO: 1363 - RNA, 23 nt, Artificial sequence
  Synthetic sequence: Target sequence of mRNA from HPV E6 reference sequence (sequence of total 19mer target site + aa at both ends)
aagacuuugcuuuucgggauuaa

SEQ ID NO: 1364 - RNA, 23 nt, Artificial sequence
  Synthetic sequence: Target sequence of mRNA from HPV E6 reference sequence (sequence of total 19mer target site + aa at both ends)
aauuagguguauuaacugucaaa

SEQ ID NO: 1365 - RNA, 23 nt, Artificial sequence
  Synthetic sequence: Target sequence of mRNA from HPV E6 reference sequence (sequence of total 19mer target site + aa at both ends)
aauuaccacaguuaugcacagaa

SEQ ID NO: 1366 - RNA, 23 nt, Artificial sequence
  Synthetic sequence: Target sequence of mRNA from HPV E6 reference sequence (sequence of total 19mer target site + aa at both ends)
aagcaacaguuacugcgacguaa

SEQ ID NO: 1367 - RNA, 23 nt, Artificial sequence
  Synthetic sequence: Target sequence of mRNA from HPV E6 reference sequence (sequence of total 19mer target site + aa at both ends)
aaugcuuuucgggauuuaugcaa

SEQ ID NO: 1368 - RNA, 23 nt, Artificial sequence
  Synthetic sequence: Target sequence of mRNA from HPV E6 reference sequence (sequence of total 19mer target site + aa at both ends)
aauuagugaguauagacauuaaa

SEQ ID NO: 1369 - RNA, 23 nt, Artificial sequence
  Synthetic sequence: Target sequence of mRNA from HPV E6 reference sequence (sequence of total 19mer target site + aa at both ends)
aauaauuagguguauuaacugaa

SEQ ID NO: 1370 - RNA, 23 nt, Artificial sequence
  Synthetic sequence: Target sequence of mRNA from HPV E6 reference sequence (sequence of total 19mer target site + aa at both ends)
aagauguaugucuuguugcagaa

SEQ ID NO: 1371 - RNA, 23 nt, Artificial sequence
  Synthetic sequence: Target sequence of mRNA from HPV E6 reference sequence (sequence of total 19mer target site + aa at both ends)
aaccggucgauguaugucuugaa

SEQ ID NO: 1372 - RNA, 23 nt, Artificial sequence
  Synthetic sequence: Target sequence of mRNA from HPV E6 reference sequence (sequence of total 19mer target site + aa at both ends)
aaggagcgacccagaaaguuaaa

SEQ ID NO: 1373 - RNA, 23 nt, Artificial sequence
  Synthetic sequence: Target sequence of mRNA from HPV E6 reference sequence (sequence of total 19mer target site + aa at both ends)
aagagcgacccagaaaguuacaa

SEQ ID NO: 1374 - RNA, 23 nt, Artificial sequence
  Synthetic sequence: Target sequence of mRNA from HPV E6 reference sequence (sequence of total 19mer target site + aa at both ends)
aaugaguauagacauuauuguaa

SEQ ID NO: 1375 - RNA, 23 nt, Artificial sequence
  Synthetic sequence: Target sequence of mRNA from HPV E6 reference sequence (sequence of total 19mer target site + aa at both ends)
aaaauacaacaaaccguugugaa

SEQ ID NO: 1376 - RNA, 23 nt, Artificial sequence
  Synthetic sequence: Target sequence of mRNA from HPV E6 reference sequence (sequence of total 19mer target site + aa at both ends)
aaguaugucuuguugcagaucaa

SEQ ID NO: 1377 - RNA, 23 nt, Artificial sequence
  Synthetic sequence: Target sequence of mRNA from HPV E6 reference sequence (sequence of total 19mer target site + aa at both ends)
aacuuugcuuuucgggauuuaaa

SEQ ID NO: 1378 - RNA, 23 nt, Artificial sequence
  Synthetic sequence: Target sequence of mRNA from HPV E6 reference sequence (sequence of total 19mer target site + aa at both ends)
aaauuagugaguauagacauuaa

SEQ ID NO: 1379 - RNA, 23 nt, Artificial sequence
  Synthetic sequence: Target sequence of mRNA from HPV E6 reference sequence (sequence of total 19mer target site + aa at both ends)
aaaagauuccauaauauaaggaa

SEQ ID NO: 1380 - RNA, 23 nt, Artificial sequence
  Synthetic sequence: Target sequence of mRNA from HPV E6 reference sequence (sequence of total 19mer target site + aa at both ends)
aaggucgauguaugucuuguuaa

SEQ ID NO: 1381 - RNA, 23 nt, Artificial sequence
  Synthetic sequence: Target sequence of mRNA from HPV E6 reference sequence (sequence of total 19mer target site + aa at both ends)
aacaucaagaacacguagagaaa

SEQ ID NO: 1382 - RNA, 23 nt, Artificial sequence
  Synthetic sequence: Target sequence of mRNA from HPV E6 reference sequence (sequence of total 19mer target site + aa at both ends)
aaaacaguuacugcgacgugaaa

SEQ ID NO: 1383 - RNA, 23 nt, Artificial sequence
  Synthetic sequence: Target sequence of mRNA from HPV E6 reference sequence (sequence of total 19mer target site + aa at both ends)
aaacaguuacugcgacgugagaa

SEQ ID NO: 1384 - RNA, 23 nt, Artificial sequence
  Synthetic sequence: Target sequence of mRNA from HPV E6 reference sequence (sequence of total 19mer target site + aa at both ends)
aagugugauuuguuaauuaggaa

SEQ ID NO: 1385 - RNA, 23 nt, Artificial sequence
  Synthetic sequence: Target sequence of mRNA from HPV E6 reference sequence (sequence of total 19mer target site + aa at both ends)
aaaucaagaacacguagagaaaa

SEQ ID NO: 1386 - RNA, 23 nt, Artificial sequence
  Synthetic sequence: Target sequence of mRNA from HPV E6 reference sequence (sequence of total 19mer target site + aa at both ends)
aauuucgggauuuaugcauagaa

SEQ ID NO: 1387 - RNA, 23 nt, Artificial sequence
  Synthetic sequence: Target sequence of mRNA from HPV E6 reference sequence (sequence of total 19mer target site + aa at both ends)
aaacccacaggagcgacccagaa

SEQ ID NO: 1388 - RNA, 23 nt, Artificial sequence
  Synthetic sequence: Target sequence of mRNA from HPV E6 reference sequence (sequence of total 19mer target site + aa at both ends)
aaagaugggaauccauaugcuaa

SEQ ID NO: 1389 - RNA, 23 nt, Artificial sequence
  Synthetic sequence: Target sequence of mRNA from HPV E6 reference sequence (sequence of total 19mer target site + aa at both ends)
aauagugaguauagacauuauaa

SEQ ID NO: 1390 - RNA, 23 nt, Artificial sequence
  Synthetic sequence: Target sequence of mRNA from HPV E6 reference sequence (sequence of total 19mer target site + aa at both ends)
aaugugugauuuguuaauuagaa

SEQ ID NO: 1391 - RNA, 23 nt, Artificial sequence
  Synthetic sequence: Target sequence of mRNA from HPV E6 reference sequence (sequence of total 19mer target site + aa at both ends)
aauuaauuagguguauuaacuaa

SEQ ID NO: 1392 - RNA, 23 nt, Artificial sequence
  Synthetic sequence: Target sequence of mRNA from HPV E6 reference sequence (sequence of total 19mer target site + aa at both ends)
aaauaugacuuugcuuuucggaa

SEQ ID NO: 1393 - RNA, 23 nt, Artificial sequence
  Synthetic sequence: Target sequence of mRNA from HPV E6 reference sequence (sequence of total 19mer target site + aa at both ends)
aacggucgauguaugucuuguaa

SEQ ID NO: 1394 - RNA, 23 nt, Artificial sequence
  Synthetic sequence: Target sequence of mRNA from HPV E6 reference sequence (sequence of total 19mer target site + aa at both ends)
aacaggacccacaggagcgacaa

SEQ ID NO: 1395 - RNA, 23 nt, Artificial sequence
  Synthetic sequence: Target sequence of mRNA from HPV E6 reference sequence (sequence of total 19mer target site + aa at both ends)
aauuuucgggauuuaugcauaaa

SEQ ID NO: 1396 - RNA, 23 nt, Artificial sequence
  Synthetic sequence: Target sequence of mRNA from HPV E6 reference sequence (sequence of total 19mer target site + aa at both ends)
aaaaacaacuauacaugauauaa

SEQ ID NO: 1397 - RNA, 23 nt, Artificial sequence
  Synthetic sequence: Target sequence of mRNA from HPV E6 reference sequence (sequence of total 19mer target site + aa at both ends)
aauccauaugcuguaugugauaa

SEQ ID NO: 1398 - RNA, 23 nt, Artificial sequence
  Synthetic sequence: Target sequence of mRNA from HPV E6 reference sequence (sequence of total 19mer target site + aa at both ends)
aauauucuaaaauuagugaguaa

SEQ ID NO: 1399 - RNA, 23 nt, Artificial sequence
  Synthetic sequence: Target sequence of mRNA from HPV E6 reference sequence (sequence of total 19mer target site + aa at both ends)
aauauggaacaacauuagaacaa

SEQ ID NO: 1400 - RNA, 23 nt, Artificial sequence
  Synthetic sequence: Target sequence of mRNA from HPV E6 reference sequence (sequence of total 19mer target site + aa at both ends)
aagucuuguugcagaucaucaaa

SEQ ID NO: 1401 - RNA, 23 nt, Artificial sequence
  Synthetic sequence: Target sequence of mRNA from HPV E6 reference sequence (sequence of total 19mer target site + aa at both ends)
aauauuaacugucaaaagccaaa

SEQ ID NO: 1402 - RNA, 23 nt, Artificial sequence
  Synthetic sequence: Target sequence of mRNA from HPV E6 reference sequence (sequence of total 19mer target site + aa at both ends)
aaaccaaaagagaacugcaauaa

SEQ ID NO: 1403 - RNA, 23 nt, Artificial sequence
  Synthetic sequence: Target sequence of mRNA from HPV E6 reference sequence (sequence of total 19mer target site + aa at both ends)
aaaauuagugaguauagacauaa

SEQ ID NO: 1404 - RNA, 23 nt, Artificial sequence
  Synthetic sequence: Target sequence of mRNA from HPV E6 reference sequence (sequence of total 19mer target site + aa at both ends)
aacagaucaucaagaacacguaa

SEQ ID NO: 1405 - RNA, 23 nt, Artificial sequence
  Synthetic sequence: Target sequence of mRNA from HPV E6 reference sequence (sequence of total 19mer target site + aa at both ends)
aauaugcauaguauauagagaaa

SEQ ID NO: 1406 - RNA, 23 nt, Artificial sequence
  Synthetic sequence: Target sequence of mRNA from HPV E6 reference sequence (sequence of total 19mer target site + aa at both ends)
aaagagaugggaauccauaugaa

SEQ ID NO: 1407 - RNA, 23 nt, Artificial sequence
  Synthetic sequence: Target sequence of mRNA from HPV E6 reference sequence (sequence of total 19mer target site + aa at both ends)
aaagugaguauagacauuauuaa

SEQ ID NO: 1408 - RNA, 23 nt, Artificial sequence
  Synthetic sequence: Target sequence of mRNA from HPV E6 reference sequence (sequence of total 19mer target site + aa at both ends)
aauucuaaaauuagugaguauaa

SEQ ID NO: 1409 - RNA, 23 nt, Artificial sequence
  Synthetic sequence: Target sequence of mRNA from HPV E6 reference sequence (sequence of total 19mer target site + aa at both ends)
aaaugcauaguauauagagauaa

SEQ ID NO: 1410 - RNA, 23 nt, Artificial sequence
  Synthetic sequence: Target sequence of mRNA from HPV E6 reference sequence (sequence of total 19mer target site + aa at both ends)
aagugauuuguuaauuaggugaa

SEQ ID NO: 1411 - RNA, 23 nt, Artificial sequence
  Synthetic sequence: Target sequence of mRNA from HPV E6 reference sequence (sequence of total 19mer target site + aa at both ends)
aaugauuuguuaauuagguguaa

SEQ ID NO: 1412 - RNA, 23 nt, Artificial sequence
  Synthetic sequence: Target sequence of mRNA from HPV E6 reference sequence (sequence of total 19mer target site + aa at both ends)
aagauuuguuaauuagguguaaa

SEQ ID NO: 1413 - RNA, 23 nt, Artificial sequence
  Synthetic sequence: Target sequence of mRNA from HPV E6 reference sequence (sequence of total 19mer target site + aa at both ends)
aaauuuguuaauuagguguauaa

SEQ ID NO: 1414 - RNA, 23 nt, Artificial sequence
  Synthetic sequence: Target sequence of mRNA from HPV E6 reference sequence (sequence of total 19mer target site + aa at both ends)
aaugugauuuguuaauuagguaa

SEQ ID NO: 1415 - RNA, 23 nt, Artificial sequence
  Synthetic sequence: Target sequence of mRNA from HPV E6 reference sequence (sequence of total 19mer target site + aa at both ends)
aauguauggaacaacauuagaaa

SEQ ID NO: 1416 - RNA, 23 nt, Artificial sequence
  Synthetic sequence: Target sequence of mRNA from HPV E6 reference sequence (sequence of total 19mer target site + aa at both ends)
aaguauggaacaacauuagaaaa

SEQ ID NO: 1417 - RNA, 23 nt, Artificial sequence
  Synthetic sequence: Target sequence of mRNA from HPV E6 reference sequence (sequence of total 19mer target site + aa at both ends)
aauguguacugcaagcaacagaa

SEQ ID NO: 1418 - RNA, 23 nt, Artificial sequence
  Synthetic sequence: Target sequence of mRNA from HPV E6 reference sequence (sequence of total 19mer target site + aa at both ends)
aaacugcgacgugagguauauaa

SEQ ID NO: 1419 - RNA, 23 nt, Artificial sequence
  Synthetic sequence: Target sequence of mRNA from HPV E6 reference sequence (sequence of total 19mer target site + aa at both ends)
aagagguauaugacuuugcuuaa

SEQ ID NO: 1420 - RNA, 23 nt, Artificial sequence
  Synthetic sequence: Target sequence of mRNA from HPV E6 reference sequence (sequence of total 19mer target site + aa at both ends)
aaaugcuguaugugauaaaugaa

SEQ ID NO: 1421 - RNA, 23 nt, Artificial sequence
  Synthetic sequence: Target sequence of mRNA from HPV E6 reference sequence (sequence of total 19mer target site + aa at both ends)
aauuuauucuaaaauuagugaaa

SEQ ID NO: 1422 - RNA, 23 nt, Artificial sequence
  Synthetic sequence: Target sequence of mRNA from HPV E6 reference sequence (sequence of total 19mer target site + aa at both ends)
aacugcgacgugagguauaugaa

SEQ ID NO: 1423 - RNA, 23 nt, Artificial sequence
  Synthetic sequence: Target sequence of mRNA from HPV E6 reference sequence (sequence of total 19mer target site + aa at both ends)
aaaccguugugugauuuguuaaa

SEQ ID NO: 1424 - DNA, 21 bp, Artificial sequence
  Synthetic sequence: dsRNA targeting HPV E6 Gene Expression. Sense strand (target sequence) having double TT overhang
ucgguggaccggucgaugutt

SEQ ID NO: 1425 - DNA, 21 bp, Artificial sequence
  Synthetic sequence: dsRNA targeting HPV E6 Gene Expression. Sense strand (target sequence) having double TT overhang
ggucgguggaccggucgautt

SEQ ID NO: 1426 - DNA, 21 bp, Artificial sequence
  Synthetic sequence: dsRNA targeting HPV E6 Gene Expression. Sense strand (target sequence) having double TT overhang
cgguggaccggucgauguatt

SEQ ID NO: 1427 - DNA, 21 bp, Artificial sequence
  Synthetic sequence: dsRNA targeting HPV E6 Gene Expression. Sense strand (target sequence) having double TT overhang
gucgguggaccggucgaugtt

SEQ ID NO: 1428 - DNA, 21 bp, Artificial sequence
  Synthetic sequence: dsRNA targeting HPV E6 Gene Expression. Sense strand (target sequence) having double TT overhang
aucaucaagaacacguagatt

SEQ ID NO: 1429 - DNA, 21 bp, Artificial sequence
  Synthetic sequence: dsRNA targeting HPV E6 Gene Expression. Sense strand (target sequence) having double TT overhang
caacaguuacugcgacgugtt

SEQ ID NO: 1430 - DNA, 21 bp, Artificial sequence
  Synthetic sequence: dsRNA targeting HPV E6 Gene Expression. Sense strand (target sequence) having double TT overhang
caauacaacaaaccguugutt

SEQ ID NO: 1431 - DNA, 21 bp, Artificial sequence
  Synthetic sequence: dsRNA targeting HPV E6 Gene Expression. Sense strand (target sequence) having double TT overhang
gcugcaaacaacuauacautt

SEQ ID NO: 1432 - DNA, 21 bp, Artificial sequence
  Synthetic sequence: dsRNA targeting HPV E6 Gene Expression. Sense strand (target sequence) having double TT overhang
gguggaccggucgauguautt

SEQ ID NO: 1433 - DNA, 21 bp, Artificial sequence
  Synthetic sequence: dsRNA targeting HPV E6 Gene Expression. Sense strand (target sequence) having double TT overhang
aaauuagugaguauagacatt

SEQ ID NO: 1434 - DNA, 21 bp, Artificial sequence
  Synthetic sequence: dsRNA targeting HPV E6 Gene Expression. Sense strand (target sequence) having double TT overhang
ucaucaagaacacguagagtt

SEQ ID NO: 1435 - DNA, 21 bp, Artificial sequence
  Synthetic sequence: dsRNA targeting HPV E6 Gene Expression. Sense strand (target sequence) having double TT overhang
auacaacaaaccguugugutt

SEQ ID NO: 1436 - DNA, 21 bp, Artificial sequence
  Synthetic sequence: dsRNA targeting HPV E6 Gene Expression. Sense strand (target sequence) having double TT overhang
uggaccggucgauguaugutt

SEQ ID NO: 1437 - DNA, 21 bp, Artificial sequence
  Synthetic sequence: dsRNA targeting HPV E6 Gene Expression. Sense strand (target sequence) having double TT overhang
uacaacaaaccguugugugtt

SEQ ID NO: 1438 - DNA, 21 bp, Artificial sequence
  Synthetic sequence: dsRNA targeting HPV E6 Gene Expression. Sense strand (target sequence) having double TT overhang
agauuccauaauauaagggtt

SEQ ID NO: 1439 - DNA, 21 bp, Artificial sequence
  Synthetic sequence: dsRNA targeting HPV E6 Gene Expression. Sense strand (target sequence) having double TT overhang
caagcaacaguuacugcgatt

SEQ ID NO: 1440 - DNA, 21 bp, Artificial sequence
  Synthetic sequence: dsRNA targeting HPV E6 Gene Expression. Sense strand (target sequence) having double TT overhang
guuaauuagguguauuaactt

SEQ ID NO: 1441 - DNA, 21 bp, Artificial sequence
  Synthetic sequence: dsRNA targeting HPV E6 Gene Expression. Sense strand (target sequence) having double TT overhang
uuugcuuuucgggauuuautt

SEQ ID NO: 1442 - DNA, 21 bp, Artificial sequence
  Synthetic sequence: dsRNA targeting HPV E6 Gene Expression. Sense strand (target sequence) having double TT overhang
acuuugcuuuucgggauuutt

SEQ ID NO: 1443 - DNA, 21 bp, Artificial sequence
  Synthetic sequence: dsRNA targeting HPV E6 Gene Expression. Sense strand (target sequence) having double TT overhang
cugcaaacaacuauacaugtt

SEQ ID NO: 1444 - DNA, 21 bp, Artificial sequence
  Synthetic sequence: dsRNA targeting HPV E6 Gene Expression. Sense strand (target sequence) having double TT overhang
augacuuugcuuuucgggatt

SEQ ID NO: 1445 - DNA, 21 bp, Artificial sequence
  Synthetic sequence: dsRNA targeting HPV E6 Gene Expression. Sense strand (target sequence) having double TT overhang
cgacccagaaaguuaccactt

SEQ ID NO: 1446 - DNA, 21 bp, Artificial sequence
  Synthetic sequence: dsRNA targeting HPV E6 Gene Expression. Sense strand (target sequence) having double TT overhang
uuacugcgacgugagguautt

SEQ ID NO: 1447 - DNA, 21 bp, Artificial sequence
  Synthetic sequence: dsRNA targeting HPV E6 Gene Expression. Sense strand (target sequence) having double TT overhang
guuacugcgacgugagguatt

SEQ ID NO: 1448 - DNA, 21 bp, Artificial sequence
  Synthetic sequence: dsRNA targeting HPV E6 Gene Expression. Sense strand (target sequence) having double TT overhang
ugcgacgugagguauaugatt

SEQ ID NO: 1449 - DNA, 21 bp, Artificial sequence
  Synthetic sequence: dsRNA targeting HPV E6 Gene Expression. Sense strand (target sequence) having double TT overhang
gucgauguaugucuuguugtt

SEQ ID NO: 1450 - DNA, 21 bp, Artificial sequence
  Synthetic sequence: dsRNA targeting HPV E6 Gene Expression. Sense strand (target sequence) having double TT overhang
cgacgugagguauaugacutt

SEQ ID NO: 1451 - DNA, 21 bp, Artificial sequence
  Synthetic sequence: dsRNA targeting HPV E6 Gene Expression. Sense strand (target sequence) having double TT overhang
gacuuugcuuuucgggauutt

SEQ ID NO: 1452 - DNA, 21 bp, Artificial sequence
  Synthetic sequence: dsRNA targeting HPV E6 Gene Expression. Sense strand (target sequence) having double TT overhang
uuagguguauuaacugucatt

SEQ ID NO: 1453 - DNA, 21 bp, Artificial sequence
  Synthetic sequence: dsRNA targeting HPV E6 Gene Expression. Sense strand (target sequence) having double TT overhang
uuaccacaguuaugcacagtt

SEQ ID NO: 1454 - DNA, 21 bp, Artificial sequence
  Synthetic sequence: dsRNA targeting HPV E6 Gene Expression. Sense strand (target sequence) having double TT overhang
gcaacaguuacugcgacgutt

SEQ ID NO: 1455 - DNA, 21 bp, Artificial sequence
  Synthetic sequence: dsRNA targeting HPV E6 Gene Expression. Sense strand (target sequence) having double TT overhang
ugcuuuucgggauuuaugctt

SEQ ID NO: 1456 - DNA, 21 bp, Artificial sequence
  Synthetic sequence: dsRNA targeting HPV E6 Gene Expression. Sense strand (target sequence) having double TT overhang
uuagugaguauagacauuatt

SEQ ID NO: 1457 - DNA, 21 bp, Artificial sequence
  Synthetic sequence: dsRNA targeting HPV E6 Gene Expression. Sense strand (target sequence) having double TT overhang
uaauuagguguauuaacugtt

SEQ ID NO: 1458 - DNA, 21 bp, Artificial sequence
  Synthetic sequence: dsRNA targeting HPV E6 Gene Expression. Sense strand (target sequence) having double TT overhang
gauguaugucuuguugcagtt

SEQ ID NO: 1459 - DNA, 21 bp, Artificial sequence
  Synthetic sequence: dsRNA targeting HPV E6 Gene Expression. Sense strand (target sequence) having double TT overhang
ccggucgauguaugucuugtt

SEQ ID NO: 1460 - DNA, 21 bp, Artificial sequence
  Synthetic sequence: dsRNA targeting HPV E6 Gene Expression. Sense strand (target sequence) having double TT overhang
ggagcgacccagaaaguuatt

SEQ ID NO: 1461 - DNA, 21 bp, Artificial sequence
  Synthetic sequence: dsRNA targeting HPV E6 Gene Expression. Sense strand (target sequence) having double TT overhang
gagcgacccagaaaguuactt

SEQ ID NO: 1462 - DNA, 21 bp, Artificial sequence
  Synthetic sequence: dsRNA targeting HPV E6 Gene Expression. Sense strand (target sequence) having double TT overhang
ugaguauagacauuauugutt

SEQ ID NO: 1463 - DNA, 21 bp, Artificial sequence
  Synthetic sequence: dsRNA targeting HPV E6 Gene Expression. Sense strand (target sequence) having double TT overhang
aauacaacaaaccguugugtt

SEQ ID NO: 1464 - DNA, 21 bp, Artificial sequence
  Synthetic sequence: dsRNA targeting HPV E6 Gene Expression. Sense strand (target sequence) having double TT overhang
guaugucuuguugcagauctt

SEQ ID NO: 1465 - DNA, 21 bp, Artificial sequence
  Synthetic sequence: dsRNA targeting HPV E6 Gene Expression. Sense strand (target sequence) having double TT overhang
cuuugcuuuucgggauuuatt

SEQ ID NO: 1466 - DNA, 21 bp, Artificial sequence
  Synthetic sequence: dsRNA targeting HPV E6 Gene Expression. Sense strand (target sequence) having double TT overhang
auuagugaguauagacauutt

SEQ ID NO: 1467 - DNA, 21 bp, Artificial sequence
  Synthetic sequence: dsRNA targeting HPV E6 Gene Expression. Sense strand (target sequence) having double TT overhang
aagauuccauaauauaaggtt

SEQ ID NO: 1468 - DNA, 21 bp, Artificial sequence
  Synthetic sequence: dsRNA targeting HPV E6 Gene Expression. Sense strand (target sequence) having double TT overhang
ggucgauguaugucuuguutt

SEQ ID NO: 1469 - DNA, 21 bp, Artificial sequence
  Synthetic sequence: dsRNA targeting HPV E6 Gene Expression. Sense strand (target sequence) having double TT overhang
caucaagaacacguagagatt

SEQ ID NO: 1470 - DNA, 21 bp, Artificial sequence
  Synthetic sequence: dsRNA targeting HPV E6 Gene Expression. Sense strand (target sequence) having double TT overhang
aacaguuacugcgacgugatt

SEQ ID NO: 1471 - DNA, 21 bp, Artificial sequence
  Synthetic sequence: dsRNA targeting HPV E6 Gene Expression. Sense strand (target sequence) having double TT overhang
acaguuacugcgacgugagtt

SEQ ID NO: 1472 - DNA, 21 bp, Artificial sequence
  Synthetic sequence: dsRNA targeting HPV E6 Gene Expression. Sense strand (target sequence) having double TT overhang
gugugauuuguuaauuaggtt

SEQ ID NO: 1473 - DNA, 21 bp, Artificial sequence
  Synthetic sequence: dsRNA targeting HPV E6 Gene Expression. Sense strand (target sequence) having double TT overhang
aucaagaacacguagagaatt

SEQ ID NO: 1474 - DNA, 21 bp, Artificial sequence
  Synthetic sequence: dsRNA targeting HPV E6 Gene Expression. Sense strand (target sequence) having double TT overhang
uuucgggauuuaugcauagtt

SEQ ID NO: 1475 - DNA, 21 bp, Artificial sequence
  Synthetic sequence: dsRNA targeting HPV E6 Gene Expression. Sense strand (target sequence) having double TT overhang
acccacaggagcgacccagtt

SEQ ID NO: 1476 - DNA, 21 bp, Artificial sequence
  Synthetic sequence: dsRNA targeting HPV E6 Gene Expression. Sense strand (target sequence) having double TT overhang
agaugggaauccauaugcutt

SEQ ID NO: 1477 - DNA, 21 bp, Artificial sequence
  Synthetic sequence: dsRNA targeting HPV E6 Gene Expression. Sense strand (target sequence) having double TT overhang
uagugaguauagacauuautt

SEQ ID NO: 1478 - DNA, 21 bp, Artificial sequence
  Synthetic sequence: dsRNA targeting HPV E6 Gene Expression. Sense strand (target sequence) having double TT overhang
ugugugauuuguuaauuagtt

SEQ ID NO: 1479 - DNA, 21 bp, Artificial sequence
  Synthetic sequence: dsRNA targeting HPV E6 Gene Expression. Sense strand (target sequence) having double TT overhang
uuaauuagguguauuaacutt

SEQ ID NO: 1480 - DNA, 21 bp, Artificial sequence
  Synthetic sequence: dsRNA targeting HPV E6 Gene Expression. Sense strand (target sequence) having double TT overhang
auaugacuuugcuuuucggtt

SEQ ID NO: 1481 - DNA, 21 bp, Artificial sequence
  Synthetic sequence: dsRNA targeting HPV E6 Gene Expression. Sense strand (target sequence) having double TT overhang
cggucgauguaugucuugutt

SEQ ID NO: 1482 - DNA, 21 bp, Artificial sequence
  Synthetic sequence: dsRNA targeting HPV E6 Gene Expression. Sense strand (target sequence) having double TT overhang
caggacccacaggagcgactt

SEQ ID NO: 1483 - DNA, 21 bp, Artificial sequence
  Synthetic sequence: dsRNA targeting HPV E6 Gene Expression. Sense strand (target sequence) having double TT overhang
uuuucgggauuuaugcauatt

SEQ ID NO: 1484 - DNA, 21 bp, Artificial sequence
  Synthetic sequence: dsRNA targeting HPV E6 Gene Expression. Sense strand (target sequence) having double TT overhang
aaacaacuauacaugauautt

SEQ ID NO: 1485 - DNA, 21 bp, Artificial sequence
  Synthetic sequence: dsRNA targeting HPV E6 Gene Expression. Sense strand (target sequence) having double TT overhang
uccauaugcuguaugugautt

SEQ ID NO: 1486 - DNA, 21 bp, Artificial sequence
  Synthetic sequence: dsRNA targeting HPV E6 Gene Expression. Sense strand (target sequence) having double TT overhang
uauucuaaaauuagugagutt

SEQ ID NO: 1487 - DNA, 21 bp, Artificial sequence
  Synthetic sequence: dsRNA targeting HPV E6 Gene Expression. Sense strand (target sequence) having double TT overhang
uauggaacaacauuagaactt

SEQ ID NO: 1488 - DNA, 21 bp, Artificial sequence
  Synthetic sequence: dsRNA targeting HPV E6 Gene Expression. Sense strand (target sequence) having double TT overhang
gucuuguugcagaucaucatt

SEQ ID NO: 1489 - DNA, 21 bp, Artificial sequence
  Synthetic sequence: dsRNA targeting HPV E6 Gene Expression. Sense strand (target sequence) having double TT overhang
uauuaacugucaaaagccatt

SEQ ID NO: 1490 - DNA, 21 bp, Artificial sequence
  Synthetic sequence: dsRNA targeting HPV E6 Gene Expression. Sense strand (target sequence) having double TT overhang
accaaaagagaacugcaautt

SEQ ID NO: 1491 - DNA, 21 bp, Artificial sequence
  Synthetic sequence: dsRNA targeting HPV E6 Gene Expression. Sense strand (target sequence) having double TT overhang
aauuagugaguauagacautt

SEQ ID NO: 1492 - DNA, 21 bp, Artificial sequence
  Synthetic sequence: dsRNA targeting HPV E6 Gene Expression. Sense strand (target sequence) having double TT overhang
cagaucaucaagaacacgutt

SEQ ID NO: 1493 - DNA, 21 bp, Artificial sequence
  Synthetic sequence: dsRNA targeting HPV E6 Gene Expression. Sense strand (target sequence) having double TT overhang
uaugcauaguauauagagatt

SEQ ID NO: 1494 - DNA, 21 bp, Artificial sequence
  Synthetic sequence: dsRNA targeting HPV E6 Gene Expression. Sense strand (target sequence) having double TT overhang
agagaugggaauccauaugtt

SEQ ID NO: 1495 - DNA, 21 bp, Artificial sequence
  Synthetic sequence: dsRNA targeting HPV E6 Gene Expression. Sense strand (target sequence) having double TT overhang
agugaguauagacauuauutt

SEQ ID NO: 1496 - DNA, 21 bp, Artificial sequence
  Synthetic sequence: dsRNA targeting HPV E6 Gene Expression. Sense strand (target sequence) having double TT overhang
uucuaaaauuagugaguautt

SEQ ID NO: 1497 - DNA, 21 bp, Artificial sequence
  Synthetic sequence: dsRNA targeting HPV E6 Gene Expression. Sense strand (target sequence) having double TT overhang
augcauaguauauagagautt

SEQ ID NO: 1498 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (2)..(2): cm
  modified_base (5)..(5): um
  modified_base (9)..(10): cm
  modified_base (13)..(13): um
  modified_base (14)..(14): cm
  modified_base (17)..(17): um
  modified_base (19)..(19): um
  misc_feature 20: t is deoxy-thymidine-5prime-phosphorothioate
ucgguggaccggucgaugutt

SEQ ID NO: 1499 - DNA, 21 bp, Artificial sequence
  Synthetic sequence: dsRNA targeting HPV E6 Gene Expression. Sense strand (target sequence) having double TT overhang
  modified_base (3)..(3): um
  modified_base (4)..(4): cm
  modified_base (7)..(7): um
  modified_base (11)..(12): cm
  modified_base (15)..(15): um
  modified_base (16)..(16): cm
  modified_base (19)..(19): um
  misc_feature 20: t is deoxy-thymidine-5prime-phosphorothioate
ggucgguggaccggucgautt

SEQ ID NO: 1500 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (4)..(4): um
  modified_base (8)..(9): cm
  modified_base (12)..(12): um
  modified_base (13)..(13): cm
  modified_base (16)..(16): um
  modified_base (18)..(18): um
  misc_feature 20: t is deoxy-thymidine-5prime-phosphorothioate
cgguggaccggucgauguatt

SEQ ID NO: 1501 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (3)..(3): cm
  modified_base (6)..(6): um
  modified_base (10)..(11): cm
  modified_base (14)..(14): um
  modified_base (15)..(15): cm
  modified_base (18)..(18): um
  misc_feature 20: t is deoxy-thymidine-5prime-phosphorothioate
gucgguggaccggucgaugtt

SEQ ID NO: 1502 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (3)..(3): cm
  modified_base (5)..(5): um
  modified_base (6)..(6): cm
  modified_base (12)..(12): cm
  modified_base (14)..(14): cm
  modified_base (16)..(16): um
  misc_feature 20: t is deoxy-thymidine-5prime-phosphorothioate
aucaucaagaacacguagatt

SEQ ID NO: 1503 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (4)..(4): cm
  modified_base (7)..(8): um
  modified_base (10)..(10): cm
  modified_base (11)..(11): um
  modified_base (13)..(13): cm
  modified_base (16)..(16): cm
  modified_base (18)..(18): um
  misc_feature 20: t is deoxy-thymidine-5prime-phosphorothioate
caacaguuacugcgacgugtt

SEQ ID NO: 1504 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (4)..(4): um
  modified_base (6)..(6): cm
  modified_base (9)..(9): cm
  modified_base (13)..(14): cm
  modified_base (16)..(17): um
  modified_base (19)..(19): um
  misc_feature 20: t is deoxy-thymidine-5prime-phosphorothioate
caauacaacaaaccguugutt

SEQ ID NO: 1505 - DNA, 21 bp, Artificial sequence
  Synthetic sequence: dsRNA targeting HPV E6 Gene Expression. Sense strand (target sequence) having double TT overhang
  modified_base (2)..(2): cm
  modified_base (3)..(3): um
  modified_base (5)..(5): cm
  modified_base (9)..(9): cm
  modified_base (12)..(12): cm
  modified_base (13)..(13): um
  modified_base (15)..(15): um
  modified_base (17)..(17): cm
  modified_base (19)..(19): um
  misc_feature 20: t is deoxy-thymidine-5prime-phosphorothioate
gcugcaaacaacuauacautt

SEQ ID NO: 1506 - DNA, 21 bp, Artificial sequence
  Synthetic sequence: dsRNA targeting HPV E6 Gene Expression. Sense strand (target sequence) having double TT overhang
  modified_base (3)..(3): um
  modified_base (7)..(8): cm
  modified_base (11)..(11): um
  modified_base (12)..(12): cm
  modified_base (15)..(15): um
  modified_base (17)..(17): um
  modified_base (19)..(19): um
  misc_feature 20: t is deoxy-thymidine-5prime-phosphorothioate
gguggaccggucgauguautt

SEQ ID NO: 1507 - DNA, 21 bp, Artificial sequence
  Synthetic sequence: dsRNA targeting HPV E6 Gene Expression. Sense strand (target sequence) having double TT overhang
  modified_base (4)..(5): um
  modified_base (8)..(8): um
  modified_base (12)..(12): um
  modified_base (14)..(14): um
  modified_base (18)..(18): cm
  misc_feature 20: t is deoxy-thymidine-5prime-phosphorothioate
aaauuagugaguauagacatt

SEQ ID NO: 1508 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (2)..(2): cm
  modified_base (4)..(4): um
  modified_base (5)..(5): cm
  modified_base (11)..(11): cm
  modified_base (13)..(13): cm
  modified_base (15)..(15): um
  misc_feature 20: t is deoxy-thymidine-5prime-phosphorothioate
ucaucaagaacacguagagtt

SEQ ID NO: 1509 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (4)..(4): cm
  modified_base (7)..(7): cm
  modified_base (11)..(12): cm
  modified_base (14)..(15): um
  modified_base (17)..(17): um
  modified_base (19)..(19): um
  misc_feature 20: t is deoxy-thymidine-5prime-phosphorothioate
auacaacaaaccguugugutt

SEQ ID NO: 1510 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (5)..(6): cm
  modified_base (9)..(9): um
  modified_base (10)..(10): cm
  modified_base (13)..(13): um
  modified_base (15)..(15): um
  modified_base (17)..(17): um
  modified_base (19)..(19): um
  misc_feature 20: t is deoxy-thymidine-5prime-phosphorothioate
uggaccggucgauguaugutt

SEQ ID NO: 1511 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (3)..(3): cm
  modified_base (6)..(6): cm
  modified_base (10)..(11): cm
  modified_base (13)..(14): um
  modified_base (16)..(16): um
  modified_base (18)..(18): um
  misc_feature 20: t is deoxy-thymidine-5prime-phosphorothioate
uacaacaaaccguugugugtt

SEQ ID NO: 1512 - DNA, 21 bp, Artificial sequence
  Synthetic sequence: dsRNA targeting HPV E6 Gene Expression. Sense strand (target sequence) having double TT overhang
  modified_base (4)..(5): um
  modified_base (6)..(7): cm
  modified_base (9)..(9): um
  modified_base (12)..(12): um
  modified_base (14)..(14): um
  misc_feature 20: t is deoxy-thymidine-5prime-phosphorothioate
agauuccauaauauaagggtt

SEQ ID NO: 1513 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (5)..(5): cm
  modified_base (8)..(8): cm
  modified_base (11)..(12): um
  modified_base (14)..(14): cm
  modified_base (15)..(15): um
  modified_base (17)..(17): cm
  misc_feature 20: t is deoxy-thymidine-5prime-phosphorothioate
caagcaacaguuacugcgatt

SEQ ID NO: 1514 - DNA, 21 bp, Artificial sequence
  Synthetic sequence: dsRNA targeting HPV E6 Gene Expression. Sense strand (target sequence) having double TT overhang
  modified_base (2)..(3): um
  modified_base (6)..(7): um
  modified_base (11)..(11): um
  modified_base (13)..(13): um
  modified_base (15)..(16): um
  modified_base (19)..(19): cm
  misc_feature 20: t is deoxy-thymidine-5prime-phosphorothioate
guuaauuagguguauuaactt

SEQ ID NO: 1515 - DNA, 21 bp, Artificial sequence
  Synthetic sequence: dsRNA targeting HPV E6 Gene Expression. Sense strand (target sequence) having double TT overhang
  modified_base (1)..(3): um
  modified_base (5)..(5): cm
  modified_base (6)..(9): um
  modified_base (10)..(10): cm
  modified_base (15)..(17): um
  modified_base (19)..(19): um
  misc_feature 20: t is deoxy-thymidine-5prime-phosphorothioate
uuugcuuuucgggauuuautt

SEQ ID NO: 1516 - DNA, 21 bp, Artificial sequence
  Synthetic sequence: dsRNA targeting HPV E6 Gene Expression. Sense strand (target sequence) having double TT overhang
  modified_base (2)..(2): cm
  modified_base (3)..(5): um
  modified_base (7)..(7): cm
  modified_base (8)..(11): um
  modified_base (12)..(12): cm
  modified_base (17)..(19): um
  misc_feature 20: t is deoxy-thymidine-5prime-phosphorothioate
acuuugcuuuucgggauuutt

SEQ ID NO: 1517 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (2)..(2): um
  modified_base (4)..(4): cm
  modified_base (8)..(8): cm
  modified_base (11)..(11): cm
  modified_base (12)..(12): um
  modified_base (14)..(14): um
  modified_base (16)..(16): cm
  modified_base (18)..(18): um
  misc_feature 20: t is deoxy-thymidine-5prime-phosphorothioate
cugcaaacaacuauacaugtt

SEQ ID NO: 1518 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (5)..(5): cm
  modified_base (6)..(8): um
  modified_base (10)..(10): cm
  modified_base (11)..(14): um
  modified_base (15)..(15): cm
  misc_feature 20: t is deoxy-thymidine-5prime-phosphorothioate
augacuuugcuuuucgggatt

SEQ ID NO: 1519 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (4)..(6): cm
  modified_base (13)..(14): um 220>
  modified_base (16)..(17): cm
  modified_base (19)..(19): cm
  misc_feature 20: t is deoxy-thymidine-5prime-phosphorothioate
cgacccagaaaguuaccactt

SEQ ID NO: 1520 - DNA, 21 bp, Artificial sequence
  Synthetic sequence: dsRNA targeting HPV E6 Gene Expression. Sense strand (target sequence) having double TT overhang
  modified_base (1)..(2): um
  modified_base (4)..(4): cm
  modified_base (5)..(5): um
  modified_base (7)..(7): cm
  modified_base (10)..(10): cm
  modified_base (12)..(12): um
  modified_base (17)..(17): um
  modified_base (19)..(19): um
  misc_feature 20: t is deoxy-thymidine-5prime-phosphorothioate
uuacugcgacgugagguautt

SEQ ID NO: 1521 - DNA, 21 bp, Artificial sequence
  Synthetic sequence: dsRNA targeting HPV E6 Gene Expression. Sense strand (target sequence) having double TT overhang
  modified_base (2)..(3): um
  modified_base (5)..(5): cm
  modified_base (6)..(6): um
  modified_base (8)..(8): cm
  modified_base (11)..(11): cm
  modified_base (13)..(13): um
  modified_base (18)..(18): um
  misc_feature 20: t is deoxy-thymidine-5prime-phosphorothioate
guuacugcgacgugagguatt

SEQ ID NO: 1522 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (3)..(3): cm
  modified_base (6)..(6): cm
  modified_base (8)..(8): um
  modified_base (13)..(13): um
  modified_base (15)..(15): um
  modified_base (17)..(17): um
  misc_feature 20: t is deoxy-thymidine-5prime-phosphorothioate
ugcgacgugagguauaugatt

SEQ ID NO: 1523 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (3)..(3): cm
  modified_base (6)..(6): um
  modified_base (8)..(8): um
  modified_base (10)..(10): um
  modified_base (12)..(12): um
  modified_base (13)..(13): cm
  modified_base (14)..(15): um
  modified_base (17)..(18): um
  misc_feature 20: t is deoxy-thymidine-5prime-phosphorothioate
gucgauguaugucuuguugtt

SEQ ID NO: 1524 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (4)..(4): cm
  modified_base (6)..(6): um
  modified_base (11)..(11): um
  modified_base (13)..(13): um
  modified_base (15)..(15): um
  modified_base (18)..(18): cm
  modified_base (19)..(19): um
  misc_feature 20: t is deoxy-thymidine-5prime-phosphorothioate
cgacgugagguauaugacutt

SEQ ID NO: 1525 - DNA, 21 bp, Artificial sequence
  Synthetic sequence: dsRNA targeting HPV E6 Gene Expression. Sense strand (target sequence) having double TT overhang
  modified_base (3)..(3): cm
  modified_base (4)..(6): um
  modified_base (8)..(8): cm
  modified_base (9)..(12): um
  modified_base (13)..(13): cm
  modified_base (18)..(19): um
  misc_feature 20: t is deoxy-thymidine-5prime-phosphorothioate
gacuuugcuuuucgggauutt

SEQ ID NO: 1526 - DNA, 21 bp, Artificial sequence
  Synthetic sequence: dsRNA targeting HPV E6 Gene Expression. Sense strand (target sequence) having double TT overhang
  modified_base (1)..(2): um
  modified_base (6)..(6): um
  modified_base (8)..(8): um
  modified_base (10)..(11): um
  modified_base (14)..(14): cm
  modified_base (15)..(15): um
  modified_base (17)..(17): um
  modified_base (18)..(18): cm
  misc_feature 20: t is deoxy-thymidine-5prime-phosphorothioate
uuagguguauuaacugucatt

SEQ ID NO: 1527 - DNA, 21 bp, Artificial sequence
  Synthetic sequence: dsRNA targeting HPV E6 Gene Expression. Sense strand (target sequence) having double TT overhang
  modified_base (1)..(2): um
  modified_base (4)..(5): cm
  modified_base (7)..(7): cm
  modified_base (10)..(11): um
  modified_base (13)..(13): um
  modified_base (15)..(15): cm
  modified_base (17)..(17): cm
  misc_feature 20: t is deoxy-thymidine-5prime-phosphorothioate
uuaccacaguuaugcacagtt

SEQ ID NO: 1528 - DNA, 21 bp, Artificial sequence
  Synthetic sequence: dsRNA targeting HPV E6 Gene Expression. Sense strand (target sequence) having double TT overhang
  modified_base (2)..(2): cm
  modified_base (5)..(5): cm
  modified_base (8)..(9): um
  modified_base (11)..(11): cm
  modified_base (12)..(12): um
  modified_base (14)..(14): cm
  modified_base (17)..(17): cm
  modified_base (19)..(19): um
  misc_feature 20: t is deoxy-thymidine-5prime-phosphorothioate
gcaacaguuacugcgacgutt

SEQ ID NO: 1529 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (3)..(3): cm
  modified_base (4)..(7): um
  modified_base (8)..(8): cm
  modified_base (13)..(15): um
  modified_base (17)..(17): um
  modified_base (19)..(19): cm
  misc_feature 20: t is deoxy-thymidine-5prime-phosphorothioate
ugcuuuucgggauuuaugctt

SEQ ID NO: 1530 - DNA, 21 bp, Artificial sequence
  Synthetic sequence: dsRNA targeting HPV E6 Gene Expression. Sense strand (target sequence) having double TT overhang
  modified_base (1)..(2): um
  modified_base (5)..(5): um
  modified_base (9)..(9): um
  modified_base (11)..(11): um
  modified_base (15)..(15): cm
  modified_base (17)..(18): um
  misc_feature 20: t is deoxy-thymidine-5prime-phosphorothioate
uuagugaguauagacauuatt

SEQ ID NO: 1531 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (4)..(5): um
  modified_base (9)..(9): um
  modified_base (11)..(11): um
  modified_base (13)..(14): um
  modified_base (17)..(17): cm
  modified_base (18)..(18): um
  misc_feature 20: t is deoxy-thymidine-5prime-phosphorothioate
uaauuagguguauuaacugtt

SEQ ID NO: 1532 - DNA, 21 bp, Artificial sequence
  Synthetic sequence: dsRNA targeting HPV E6 Gene Expression. Sense strand (target sequence) having double TT overhang
  modified_base (3)..(3): um
  modified_base (5)..(5): um
  modified_base (7)..(7): um
  modified_base (9)..(9): um
  modified_base (10)..(10): cm
  modified_base (11)..(12): um
  modified_base (14)..(15): um
  modified_base (17)..(17): cm
  misc_feature 20: t is deoxy-thymidine-5prime-phosphorothioate
gauguaugucuuguugcagtt

SEQ ID NO: 1533 - DNA, 21 bp, Artificial sequence
  Synthetic sequence: dsRNA targeting HPV E6 Gene Expression. Sense strand (target sequence) having double TT overhang
  modified_base (1)..(2): cm
  modified_base (5)..(5): um
  modified_base (6)..(6): cm
  modified_base (9)..(9): um
  modified_base (11)..(11): um
  modified_base (13)..(13): um
  modified_base (15)..(15): um
  modified_base (16)..(16): cm
  modified_base (17)..(18): um
  misc_feature 20: t is deoxy-thymidine-5prime-phosphorothioate
ccggucgauguaugucuugtt

SEQ ID NO: 1534 - DNA, 21 bp, Artificial sequence
  Synthetic sequence: dsRNA targeting HPV E6 Gene Expression. Sense strand (target sequence) having double TT overhang
  modified_base (5)..(5): cm
  modified_base (8)..(10): cm
  modified_base (17)..(18): um
  misc_feature 20: t is deoxy-thymidine-5prime-phosphorothioate
ggagcgacccagaaaguuatt

SEQ ID NO: 1535 - DNA, 21 bp, Artificial sequence
  Synthetic sequence: dsRNA targeting HPV E6 Gene Expression. Sense strand (target sequence) having double TT overhang
  modified_base (4)..(4): cm
  modified_base (7)..(9): cm
  modified_base (16)..(17): um
  modified_base (19)..(19): cm
  misc_feature 20: t is deoxy-thymidine-5prime-phosphorothioate
gagcgacccagaaaguuactt

SEQ ID NO: 1536 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (5)..(5): um
  modified_base (7)..(7): um
  modified_base (11)..(11): cm
  modified_base (13)..(14): um
  modified_base (16)..(17): um
  modified_base (19)..(19): um
  misc_feature 20: t is deoxy-thymidine-5prime-phosphorothioate
ugaguauagacauuauugutt

SEQ ID NO: 1537 - DNA, 21 bp, Artificial sequence
  Synthetic sequence: dsRNA targeting HPV E6 Gene Expression. Sense strand (target sequence) having double TT overhang
  modified_base (3)..(3): um
  modified_base (5)..(5): cm
  modified_base (8)..(8): cm
  modified_base (12)..(13): cm
  modified_base (15)..(16): um
  modified_base (18)..(18): um
  misc_feature 20: t is deoxy-thymidine-5prime-phosphorothioate
aauacaacaaaccguugugtt

SEQ ID NO: 1538 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (4)..(4): um
  modified_base (6)..(6): um
  modified_base (7)..(7): cm
  modified_base (8)..(9): um
  modified_base (11)..(12): um
  modified_base (14)..(14): cm
  modified_base (18)..(18): um
  modified_base (19)..(19): cm
  misc_feature 20: t is deoxy-thymidine-5prime-phosphorothioate
guaugucuuguugcagauctt

SEQ ID NO: 1539 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (2)..(4): um
  modified_base (6)..(6): cm
  modified_base (7)..(10): um
  modified_base (11)..(11): cm
  modified_base (16)..(18): um
  misc_feature 20: t is deoxy-thymidine-5prime-phosphorothioate
cuuugcuuuucgggauuuatt

SEQ ID NO: 1540 - DNA, 21 bp, Artificial sequence
  Synthetic sequence: dsRNA targeting HPV E6 Gene Expression. Sense strand (target sequence) having double TT overhang
  modified_base (2)..(3): um
  modified_base (6)..(6): um
  modified_base (10)..(10): um
  modified_base (12)..(12): um
  modified_base (16)..(16): cm
  modified_base (18)..(19): um
  misc_feature 20: t is deoxy-thymidine-5prime-phosphorothioate
auuagugaguauagacauutt

SEQ ID NO: 1541 - DNA, 21 bp, Artificial sequence
  Synthetic sequence: dsRNA targeting HPV E6 Gene Expression. Sense strand (target sequence) having double TT overhang
  modified_base (5)..(6): um
  modified_base (7)..(8): cm
  modified_base (10)..(10): um
  modified_base (13)..(13): um
  modified_base (15)..(15): um
  misc_feature 20: t is deoxy-thymidine-5prime-phosphorothioate
aagauuccauaauauaaggtt

SEQ ID NO: 1542 - DNA, 21 bp, Artificial sequence
  Synthetic sequence: dsRNA targeting HPV E6 Gene Expression. Sense strand (target sequence) having double TT overhang
  modified_base (3)..(3): um
  modified_base (4)..(4): cm
  modified_base (7)..(7): um
  modified_base (9)..(9): um
  modified_base (11)..(11): um
  modified_base (13)..(13): um
  modified_base (14)..(14): cm
  modified_base (15)..(16): um
  modified_base (18)..(19): um
  misc_feature 20: t is deoxy-thymidine-5prime-phosphorothioate
ggucgauguaugucuuguutt

SEQ ID NO: 1543 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (3)..(3): um
  modified_base (4)..(4): cm
  modified_base (10)..(10): cm
  modified_base (12)..(12): cm
  modified_base (14)..(14): um
  misc_feature 20: t is deoxy-thymidine-5prime-phosphorothioate
caucaagaacacguagagatt

SEQ ID NO: 1544 - DNA, 21 bp, Artificial sequence
  Synthetic sequence: dsRNA targeting HPV E6 Gene Expression. Sense strand (target sequence) having double TT overhang
  modified_base (3)..(3): cm
  modified_base (6)..(7): um
  modified_base (9)..(9): cm
  modified_base (10)..(10): um
  modified_base (12)..(12): cm
  modified_base (15)..(15): cm
  modified_base (17)..(17): um
  misc_feature 20: t is deoxy-thymidine-5prime-phosphorothioate
aacaguuacugcgacgugatt

SEQ ID NO: 1545 - DNA, 21 bp, Artificial sequence
  Synthetic sequence: dsRNA targeting HPV E6 Gene Expression. Sense strand (target sequence) having double TT overhang
  modified_base (2)..(2): cm
  modified_base (5)..(6): um
  modified_base (8)..(8): cm
  modified_base (9)..(9): um
  modified_base (11)..(11): cm
  modified_base (14)..(14): cm
  modified_base (16)..(16): um
  misc_feature 20: t is deoxy-thymidine-5prime-phosphorothioate
acaguuacugcgacgugagtt

SEQ ID NO: 1546 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (4)..(4): um
  modified_base (7)..(9): um
  modified_base (11)..(12): um
  modified_base (15)..(16): um
  misc_feature 20: t is deoxy-thymidine-5prime-phosphorothioate
gugugauuuguuaauuaggtt

SEQ ID NO: 1547 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (3)..(3): cm
  modified_base (9)..(9): cm
  modified_base (11)..(11): cm
  modified_base (13)..(13): um
  misc_feature 20: t is deoxy-thymidine-5prime-phosphorothioate
aucaagaacacguagagaatt

SEQ ID NO: 1548 - DNA, 21 bp, Artificial sequence
  Synthetic sequence: dsRNA targeting HPV E6 Gene Expression. Sense strand (target sequence) having double TT overhang
  modified_base (1)..(3): um
  modified_base (4)..(4): cm
  modified_base (9)..(11): um
  modified_base (13)..(13): um
  modified_base (15)..(15): cm
  modified_base (17)..(17): um
  misc_feature 20: t is deoxy-thymidine-5prime-phosphorothioate
uuucgggauuuaugcauagtt

SEQ ID NO: 1549 - DNA, 21 bp, Artificial sequence
  Synthetic sequence: dsRNA targeting HPV E6 Gene Expression. Sense strand (target sequence) having double TT overhang
  modified_base (2)..(4): cm
  modified_base (6)..(6): cm
  modified_base (12)..(12): cm
  modified_base (15)..(17): cm
  misc_feature 20: t is deoxy-thymidine-5prime-phosphorothioate
acccacaggagcgacccagtt

SEQ ID NO: 1550 - DNA, 21 bp, Artificial sequence
  Synthetic sequence: dsRNA targeting HPV E6 Gene Expression. Sense strand (target sequence) having double TT overhang
  modified_base (4)..(4): um
  modified_base (10)..(10): um
  modified_base (11)..(12): cm
  modified_base (14)..(14): um
  modified_base (16)..(16): um
  modified_base (18)..(18): cm
  modified_base (19)..(19): um
  misc_feature 20: t is deoxy-thymidine-5prime-phosphorothioate
agaugggaauccauaugcutt

SEQ ID NO: 1551 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (4)..(4): um
  modified_base (8)..(8): um
  modified_base (10)..(10): um
  modified_base (14)..(14): cm
  modified_base (16)..(17): um
  modified_base (19)..(19): um
  misc_feature 20: t is deoxy-thymidine-5prime-phosphorothioate
uagugaguauagacauuautt

SEQ ID NO: 1552 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (3)..(3): um
  modified_base (5)..(5): um
  modified_base (8)..(10): um
  modified_base (12)..(13): um
  modified_base (16)..(17): um
  misc_feature 20: t is deoxy-thymidine-5prime-phosphorothioate
ugugugauuuguuaauuagtt

SEQ ID NO: 1553 - DNA, 21 bp, Artificial sequence
  Synthetic sequence: dsRNA targeting HPV E6 Gene Expression. Sense strand (target sequence) having double TT overhang
  modified_base (1)..(2): um
  modified_base (5)..(6): um
  modified_base (10)..(10): um
  modified_base (12)..(12): um
  modified_base (14)..(15): um
  modified_base (18)..(18): cm
  modified_base (19)..(19): um
  misc_feature 20: t is deoxy-thymidine-5prime-phosphorothioate
uuaauuagguguauuaacutt

SEQ ID NO: 1554 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (4)..(4): um
  modified_base (7)..(7): cm
  modified_base (8)..(10): um
  modified_base (12)..(12): cm
  modified_base (13)..(16): um
  modified_base (17)..(17): cm
  misc_feature 20: t is deoxy-thymidine-5prime-phosphorothioate
auaugacuuugcuuuucggtt

SEQ ID NO: 1555 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (4)..(4): um
  modified_base (5)..(5): cm
  modified_base (8)..(8): um
  modified_base (10)..(10): um
  modified_base (12)..(12): um
  modified_base (14)..(14): um
  modified_base (15)..(15): cm
  modified_base (16)..(17): um
  modified_base (19)..(19): um
  misc_feature 20: t is deoxy-thymidine-5prime-phosphorothioate
cggucgauguaugucuugutt

SEQ ID NO: 1556 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (6)..(8): cm
  modified_base (10)..(10): cm
  modified_base (16)..(16): cm
  modified_base (19)..(19): cm
  misc_feature 20: t is deoxy-thymidine-5prime-phosphorothioate
caggacccacaggagcgactt

SEQ ID NO: 1557 - DNA, 21 bp, Artificial sequence
  Synthetic sequence: dsRNA targeting HPV E6 Gene Expression. Sense strand (target sequence) having double TT overhang
  modified_base (1)..(4): um
  modified_base (5)..(5): cm
  modified_base (10)..(12): um
  modified_base (14)..(14): um
  modified_base (16)..(16): cm
  modified_base (18)..(18): um
  misc_feature 20: t is deoxy-thymidine-5prime-phosphorothioate
uuuucgggauuuaugcauatt

SEQ ID NO: 1558 - DNA, 21 bp, Artificial sequence
  Synthetic sequence: dsRNA targeting HPV E6 Gene Expression. Sense strand (target sequence) having double TT overhang
  modified_base (4)..(4): cm
  modified_base (7)..(7): cm
  modified_base (8)..(8): um
  modified_base (10)..(10): um
  modified_base (12)..(12): cm
  modified_base (14)..(14): um
  modified_base (17)..(17): um
  modified_base (19)..(19): um
  misc_feature 20: t is deoxy-thymidine-5prime-phosphorothioate
aaacaacuauacaugauautt

SEQ ID NO: 1559 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (2)..(3): cm
  modified_base (5)..(5): um
  modified_base (7)..(7): um
  modified_base (9)..(9): cm
  modified_base (10)..(10): um
  modified_base (12)..(12): um
  modified_base (14)..(14): um
  modified_base (16)..(16): um
  modified_base (19)..(19): um
  misc_feature 20: t is deoxy-thymidine-5prime-phosphorothioate
uccauaugcuguaugugautt

SEQ ID NO: 1560 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (3)..(4): um
  modified_base (5)..(5): cm
  modified_base (6)..(6): um
  modified_base (11)..(12): um
  modified_base (15)..(15): um
  modified_base (19)..(19): um
  misc_feature 20: t is deoxy-thymidine-5prime-phosphorothioate
uauucuaaaauuagugagutt

SEQ ID NO: 1561 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (3)..(3): um
  modified_base (8)..(8): cm
  modified_base (11)..(11): cm
  modified_base (13)..(14): um
  modified_base (19)..(19): cm
  misc_feature 20: t is deoxy-thymidine-5prime-phosphorothioate
uauggaacaacauuagaactt

SEQ ID NO: 1562 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (3)..(3): cm
  modified_base (4)..(5): um
  modified_base (7)..(8): um
  modified_base (10)..(10): cm
  modified_base (14)..(14): um
  modified_base (15)..(15): cm
  modified_base (17)..(17): um
  modified_base (18)..(18): cm
  misc_feature 20: t is deoxy-thymidine-5prime-phosphorothioate
gucuuguugcagaucaucatt

SEQ ID NO: 1563 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (3)..(4): um
  modified_base (7)..(7): cm
  modified_base (8)..(8): um
  modified_base (10)..(10): um
  modified_base (11)..(11): cm
  modified_base (17)..(18): cm
  misc_feature 20: t is deoxy-thymidine-5prime-phosphorothioate
uauuaacugucaaaagccatt

SEQ ID NO: 1564 - DNA, 21 bp, Artificial sequence
  Synthetic sequence: dsRNA targeting HPV E6 Gene Expression. Sense strand (target sequence) having double TT overhang
  modified_base (2)..(3): cm
  modified_base (13)..(13): cm
  modified_base (14)..(14): um
  modified_base (16)..(16): cm
  modified_base (19)..(19): um
  misc_feature 20: t is deoxy-thymidine-5prime-phosphorothioate
accaaaagagaacugcaautt

SEQ ID NO: 1565 - DNA, 21 bp, Artificial sequence
  Synthetic sequence: dsRNA targeting HPV E6 Gene Expression. Sense strand (target sequence) having double TT overhang
  modified_base (3)..(4): um
  modified_base (7)..(7): um
  modified_base (11)..(11): um
  modified_base (13)..(13): um
  modified_base (17)..(17): cm
  modified_base (19)..(19): um
  misc_feature 20: t is deoxy-thymidine-5prime-phosphorothioate
aauuagugaguauagacautt

SEQ ID NO: 1566 - DNA, 21 bp, Artificial sequence
  Synthetic sequence: dsRNA targeting HPV E6 Gene Expression. Sense strand (target sequence) having double TT overhang
  modified_base (1)..(1): cm
  modified_base (5)..(5): um
  modified_base (6)..(6): cm
  modified_base (8)..(8): um
  modified_base (9)..(9): cm
  modified_base (15)..(15): cm
  modified_base (17)..(17): cm
  modified_base (19)..(19): um
  misc_feature 20: t is deoxy-thymidine-5prime-phosphorothioate
cagaucaucaagaacacgutt

SEQ ID NO: 1567 - DNA, 21 bp, Artificial sequence
  Synthetic sequence: dsRNA targeting HPV E6 Gene Expression. Sense strand (target sequence) having double TT overhang
  modified_base (1)..(1): um
  modified_base (3)..(3): um
  modified_base (5)..(5): cm
  modified_base (7)..(7): um
  modified_base (10)..(10): um
  modified_base (12)..(12): um
  modified_base (14)..(14): um
  misc_feature 20: t is deoxy-thymidine-5prime-phosphorothioate
uaugcauaguauauagagatt

SEQ ID NO: 1568 - DNA, 21 bp, Artificial sequence
  Synthetic sequence: dsRNA targeting HPV E6 Gene Expression. Sense strand (target sequence) having double TT overhang
  modified_base (6)..(6): um
  modified_base (12)..(12): um
  modified_base (13)..(14): cm
  modified_base (16)..(16): um
  modified_base (18)..(18): um
  misc_feature 20: t is deoxy-thymidine-5prime-phosphorothioate
agagaugggaauccauaugtt

SEQ ID NO: 1569 - DNA, 21 bp, Artificial sequence
  Synthetic sequence: dsRNA targeting HPV E6 Gene Expression. Sense strand (target sequence) having double TT overhang
  modified_base (3)..(3): um
  modified_base (7)..(7): um
  modified_base (9)..(9): um
  modified_base (13)..(13): cm
  modified_base (15)..(16): um
  modified_base (18)..(19): um
  misc_feature 20: t is deoxy-thymidine-5prime-phosphorothioate
agugaguauagacauuauutt

SEQ ID NO: 1570 - DNA, 21 bp, Artificial sequence
  Synthetic sequence: dsRNA targeting HPV E6 Gene Expression. Sense strand (target sequence) having double TT overhang
  modified_base (1)..(2): um
  modified_base (3)..(3): cm
  modified_base (4)..(4): um
  modified_base (9)..(10): um
  modified_base (13)..(13): um
  modified_base (17)..(17): um
  modified_base (19)..(19): um
  misc_feature 20: t is deoxy-thymidine-5prime-phosphorothioate
uucuaaaauuagugaguautt

SEQ ID NO: 1571 - DNA, 21 bp, Artificial sequence
  Synthetic sequence: dsRNA targeting HPV E6 Gene Expression. Sense strand (target sequence) having double TT overhang
  modified_base (2)..(2): um
  modified_base (4)..(4): cm
  modified_base (6)..(6): um
  modified_base (9)..(9): um
  modified_base (11)..(11): um
  modified_base (13)..(13): um
  modified_base (19)..(19): um
  misc_feature 20: t is deoxy-thymidine-5prime-phosphorothioate
augcauaguauauagagautt

SEQ ID NO: 1572 - DNA, 21 bp, Artificial sequence
  Synthetic sequence: dsRNA targeting HPV E6 Gene Expression. Sense strand (target sequence) having double TT overhang
gugauuuguuaauuaggugtt

SEQ ID NO: 1573 - DNA, 21 bp, Artificial sequence
  Synthetic sequence: dsRNA targeting HPV E6 Gene Expression. Sense strand (target sequence) having double TT overhang
ugauuuguuaauuaggugutt

SEQ ID NO: 1574 - DNA, 21 bp, Artificial sequence
  Synthetic sequence: dsRNA targeting HPV E6 Gene Expression. Sense strand (target sequence) having double TT overhang
gauuuguuaauuagguguatt

SEQ ID NO: 1575 - DNA, 21 bp, Artificial sequence
  Synthetic sequence: dsRNA targeting HPV E6 Gene Expression. Sense strand (target sequence) having double TT overhang
auuuguuaauuagguguautt

SEQ ID NO: 1576 - DNA, 21 bp, Artificial sequence
  Synthetic sequence: dsRNA targeting HPV E6 Gene Expression. Sense strand (target sequence) having double TT overhang
ugugauuuguuaauuaggutt

SEQ ID NO: 1577 - DNA, 21 bp, Artificial sequence
  Synthetic sequence: dsRNA targeting HPV E6 Gene Expression. Sense strand (target sequence) having double TT overhang
uguauggaacaacauuagatt

SEQ ID NO: 1578 - DNA, 21 bp, Artificial sequence
  Synthetic sequence: dsRNA targeting HPV E6 Gene Expression. Sense strand (target sequence) having double TT overhang
guauggaacaacauuagaatt

SEQ ID NO: 1579 - DNA, 21 bp, Artificial sequence
  Synthetic sequence: dsRNA targeting HPV E6 Gene Expression. Sense strand (target sequence) having double TT overhang
uguguacugcaagcaacagtt

SEQ ID NO: 1580 - DNA, 21 bp, Artificial sequence
  Synthetic sequence: dsRNA targeting HPV E6 Gene Expression. Sense strand (target sequence) having double TT overhang
acugcgacgugagguauautt

SEQ ID NO: 1581 - DNA, 21 bp, Artificial sequence
  Synthetic sequence: dsRNA targeting HPV E6 Gene Expression. Sense strand (target sequence) having double TT overhang
gagguauaugacuuugcuutt

SEQ ID NO: 1582 - DNA, 21 bp, Artificial sequence
  Synthetic sequence: dsRNA targeting HPV E6 Gene Expression. Sense strand (target sequence) having double TT overhang
augcuguaugugauaaaugtt

SEQ ID NO: 1583 - DNA, 21 bp, Artificial sequence
  Synthetic sequence: dsRNA targeting HPV E6 Gene Expression. Sense strand (target sequence) having double TT overhang
uuuauucuaaaauuagugatt

SEQ ID NO: 1584 - DNA, 21 bp, Artificial sequence
  Synthetic sequence: dsRNA targeting HPV E6 Gene Expression. Sense strand (target sequence) having double TT overhang
cugcgacgugagguauaugtt

SEQ ID NO: 1585 - DNA, 21 bp, Artificial sequence
  Synthetic sequence: dsRNA targeting HPV E6 Gene Expression. Sense strand (target sequence) having double TT overhang
accguugugugauuuguuatt

SEQ ID NO: 1586 - DNA, 21 bp, Artificial sequence
  Synthetic sequence: dsRNA targeting HPV E6 Gene Expression. Antisense strand (guide sequence) having double TT overhang
acaucgaccgguccaccgatt

SEQ ID NO: 1587 - DNA, 21 bp, Artificial sequence
  Synthetic sequence: dsRNA targeting HPV E6 Gene Expression. Antisense strand (guide sequence) having double TT overhang
aucgaccgguccaccgacctt

SEQ ID NO: 1588 - DNA, 21 bp, Artificial sequence
  Synthetic sequence: dsRNA targeting HPV E6 Gene Expression. Antisense strand (guide sequence) having double TT overhang
uacaucgaccgguccaccgtt

SEQ ID NO: 1589 - DNA, 21 bp, Artificial sequence
  Synthetic sequence: dsRNA targeting HPV E6 Gene Expression. Antisense strand (guide sequence) having double TT overhang
caucgaccgguccaccgactt

SEQ ID NO: 1590 - DNA, 21 bp, Artificial sequence
  Synthetic sequence: dsRNA targeting HPV E6 Gene Expression. Antisense strand (guide sequence) having double TT overhang
ucuacguguucuugaugautt

SEQ ID NO: 1591 - DNA, 21 bp, Artificial sequence
  Synthetic sequence: dsRNA targeting HPV E6 Gene Expression. Antisense strand (guide sequence) having double TT overhang
cacgucgcaguaacuguugtt

SEQ ID NO: 1592 - DNA, 21 bp, Artificial sequence
  Synthetic sequence: dsRNA targeting HPV E6 Gene Expression. Antisense strand (guide sequence) having double TT overhang
acaacgguuuguuguauugtt

SEQ ID NO: 1593 - DNA, 21 bp, Artificial sequence
  Synthetic sequence: dsRNA targeting HPV E6 Gene Expression. Antisense strand (guide sequence) having double TT overhang
auguauaguuguuugcagctt

SEQ ID NO: 1594 - DNA, 21 bp, Artificial sequence
  Synthetic sequence: dsRNA targeting HPV E6 Gene Expression. Antisense strand (guide sequence) having double TT overhang
auacaucgaccgguccacctt

SEQ ID NO: 1595 - DNA, 21 bp, Artificial sequence
  Synthetic sequence: dsRNA targeting HPV E6 Gene Expression. Antisense strand (guide sequence) having double TT overhang
ugucuauacucacuaauuutt

SEQ ID NO: 1596 - DNA, 21 bp, Artificial sequence
  Synthetic sequence: dsRNA targeting HPV E6 Gene Expression. Antisense strand (guide sequence) having double TT overhang
cucuacguguucuugaugatt

SEQ ID NO: 1597 - DNA, 21 bp, Artificial sequence
  Synthetic sequence: dsRNA targeting HPV E6 Gene Expression. Antisense strand (guide sequence) having double TT overhang
acacaacgguuuguuguautt

SEQ ID NO: 1598 - DNA, 21 bp, Artificial sequence
  Synthetic sequence: dsRNA targeting HPV E6 Gene Expression. Antisense strand (guide sequence) having double TT overhang
acauacaucgaccgguccatt

SEQ ID NO: 1599 - DNA, 21 bp, Artificial sequence
  Synthetic sequence: dsRNA targeting HPV E6 Gene Expression. Antisense strand (guide sequence) having double TT overhang
cacacaacgguuuguuguatt

SEQ ID NO: 1600 - DNA, 21 bp, Artificial sequence
  Synthetic sequence: dsRNA targeting HPV E6 Gene Expression. Antisense strand (guide sequence) having double TT overhang
cccuuauauuauggaaucutt

SEQ ID NO: 1601 - DNA, 21 bp, Artificial sequence
  Synthetic sequence: dsRNA targeting HPV E6 Gene Expression. Antisense strand (guide sequence) having double TT overhang
ucgcaguaacuguugcuugtt

SEQ ID NO: 1602 - DNA, 21 bp, Artificial sequence
  Synthetic sequence: dsRNA targeting HPV E6 Gene Expression. Antisense strand (guide sequence) having double TT overhang
guuaauacaccuaauuaactt

SEQ ID NO: 1603 - DNA, 21 bp, Artificial sequence
  Synthetic sequence: dsRNA targeting HPV E6 Gene Expression. Antisense strand (guide sequence) having double TT overhang
auaaaucccgaaaagcaaatt

SEQ ID NO: 1604 - DNA, 21 bp, Artificial sequence
  Synthetic sequence: dsRNA targeting HPV E6 Gene Expression. Antisense strand (guide sequence) having double TT overhang
aaaucccgaaaagcaaagutt

SEQ ID NO: 1605 - DNA, 21 bp, Artificial sequence
  Synthetic sequence: dsRNA targeting HPV E6 Gene Expression. Antisense strand (guide sequence) having double TT overhang
cauguauaguuguuugcagtt

SEQ ID NO: 1606 - DNA, 21 bp, Artificial sequence
  Synthetic sequence: dsRNA targeting HPV E6 Gene Expression. Antisense strand (guide sequence) having double TT overhang
ucccgaaaagcaaagucautt

SEQ ID NO: 1607 - DNA, 21 bp, Artificial sequence
  Synthetic sequence: dsRNA targeting HPV E6 Gene Expression. Antisense strand (guide sequence) having double TT overhang
gugguaacuuucugggucgtt

SEQ ID NO: 1608 - DNA, 21 bp, Artificial sequence
  Synthetic sequence: dsRNA targeting HPV E6 Gene Expression. Antisense strand (guide sequence) having double TT overhang
auaccucacgucgcaguaatt

SEQ ID NO: 1609 - DNA, 21 bp, Artificial sequence
  Synthetic sequence: dsRNA targeting HPV E6 Gene Expression. Antisense strand (guide sequence) having double TT overhang
uaccucacgucgcaguaactt

SEQ ID NO: 1610 - DNA, 21 bp, Artificial sequence
  Synthetic sequence: dsRNA targeting HPV E6 Gene Expression. Antisense strand (guide sequence) having double TT overhang
ucauauaccucacgucgcatt

SEQ ID NO: 1611 - DNA, 21 bp, Artificial sequence
  Synthetic sequence: dsRNA targeting HPV E6 Gene Expression. Antisense strand (guide sequence) having double TT overhang
caacaagacauacaucgactt

SEQ ID NO: 1612 - DNA, 21 bp, Artificial sequence
  Synthetic sequence: dsRNA targeting HPV E6 Gene Expression. Antisense strand (guide sequence) having double TT overhang
agucauauaccucacgucgtt

SEQ ID NO: 1613 - DNA, 21 bp, Artificial sequence
  Synthetic sequence: dsRNA targeting HPV E6 Gene Expression. Antisense strand (guide sequence) having double TT overhang
aaucccgaaaagcaaaguctt

SEQ ID NO: 1614 - DNA, 21 bp, Artificial sequence
  Synthetic sequence: dsRNA targeting HPV E6 Gene Expression. Antisense strand (guide sequence) having double TT overhang
ugacaguuaauacaccuaatt

SEQ ID NO: 1615 - DNA, 21 bp, Artificial sequence
  Synthetic sequence: dsRNA targeting HPV E6 Gene Expression. Antisense strand (guide sequence) having double TT overhang
cugugcauaacugugguaatt

SEQ ID NO: 1616 - DNA, 21 bp, Artificial sequence
  Synthetic sequence: dsRNA targeting HPV E6 Gene Expression. Antisense strand (guide sequence) having double TT overhang
acgucgcaguaacuguugctt

SEQ ID NO: 1617 - DNA, 21 bp, Artificial sequence
  Synthetic sequence: dsRNA targeting HPV E6 Gene Expression. Antisense strand (guide sequence) having double TT overhang
gcauaaaucccgaaaagcatt

SEQ ID NO: 1618 - DNA, 21 bp, Artificial sequence
  Synthetic sequence: dsRNA targeting HPV E6 Gene Expression. Antisense strand (guide sequence) having double TT overhang
uaaugucuauacucacuaatt

SEQ ID NO: 1619 - DNA, 21 bp, Artificial sequence
  Synthetic sequence: dsRNA targeting HPV E6 Gene Expression. Antisense strand (guide sequence) having double TT overhang
caguuaauacaccuaauuatt

SEQ ID NO: 1620 - DNA, 21 bp, Artificial sequence
  Synthetic sequence: dsRNA targeting HPV E6 Gene Expression. Antisense strand (guide sequence) having double TT overhang
cugcaacaagacauacauctt

SEQ ID NO: 1621 - DNA, 21 bp, Artificial sequence
  Synthetic sequence: dsRNA targeting HPV E6 Gene Expression. Antisense strand (guide sequence) having double TT overhang
caagacauacaucgaccggtt

SEQ ID NO: 1622 - DNA, 21 bp, Artificial sequence
  Synthetic sequence: dsRNA targeting HPV E6 Gene Expression. Antisense strand (guide sequence) having double TT overhang
uaacuuucugggucgcucctt

SEQ ID NO: 1623 - DNA, 21 bp, Artificial sequence
  Synthetic sequence: dsRNA targeting HPV E6 Gene Expression. Antisense strand (guide sequence) having double TT overhang
guaacuuucugggucgcuctt

SEQ ID NO: 1624 - DNA, 21 bp, Artificial sequence
  Synthetic sequence: dsRNA targeting HPV E6 Gene Expression. Antisense strand (guide sequence) having double TT overhang
acaauaaugucuauacucatt

SEQ ID NO: 1625 - DNA, 21 bp, Artificial sequence
  Synthetic sequence: dsRNA targeting HPV E6 Gene Expression. Antisense strand (guide sequence) having double TT overhang
cacaacgguuuguuguauutt

SEQ ID NO: 1626 - DNA, 21 bp, Artificial sequence
  Synthetic sequence: dsRNA targeting HPV E6 Gene Expression. Antisense strand (guide sequence) having double TT overhang
gaucugcaacaagacauactt

SEQ ID NO: 1627 - DNA, 21 bp, Artificial sequence
  Synthetic sequence: dsRNA targeting HPV E6 Gene Expression. Antisense strand (guide sequence) having double TT overhang
uaaaucccgaaaagcaaagtt

SEQ ID NO: 1628 - DNA, 21 bp, Artificial sequence
  Synthetic sequence: dsRNA targeting HPV E6 Gene Expression. Antisense strand (guide sequence) having double TT overhang
aaugucuauacucacuaautt

SEQ ID NO: 1629 - DNA, 21 bp, Artificial sequence
  Synthetic sequence: dsRNA targeting HPV E6 Gene Expression. Antisense strand (guide sequence) having double TT overhang
ccuuauauuauggaaucuutt

SEQ ID NO: 1630 - DNA, 21 bp, Artificial sequence
  Synthetic sequence: dsRNA targeting HPV E6 Gene Expression. Antisense strand (guide sequence) having double TT overhang
aacaagacauacaucgacctt

SEQ ID NO: 1631 - DNA, 21 bp, Artificial sequence
  Synthetic sequence: dsRNA targeting HPV E6 Gene Expression. Antisense strand (guide sequence) having double TT overhang
ucucuacguguucuugaugtt

SEQ ID NO: 1632 - DNA, 21 bp, Artificial sequence
  Synthetic sequence: dsRNA targeting HPV E6 Gene Expression. Antisense strand (guide sequence) having double TT overhang
ucacgucgcaguaacuguutt

SEQ ID NO: 1633 - DNA, 21 bp, Artificial sequence
  Synthetic sequence: dsRNA targeting HPV E6 Gene Expression. Antisense strand (guide sequence) having double TT overhang
cucacgucgcaguaacugutt

SEQ ID NO: 1634 - DNA, 21 bp, Artificial sequence
  Synthetic sequence: dsRNA targeting HPV E6 Gene Expression. Antisense strand (guide sequence) having double TT overhang
ccuaauuaacaaaucacactt

SEQ ID NO: 1635 - DNA, 21 bp, Artificial sequence
  Synthetic sequence: dsRNA targeting HPV E6 Gene Expression. Antisense strand (guide sequence) having double TT overhang
uucucuacguguucuugautt

SEQ ID NO: 1636 - DNA, 21 bp, Artificial sequence
  Synthetic sequence: dsRNA targeting HPV E6 Gene Expression. Antisense strand (guide sequence) having double TT overhang
cuaugcauaaaucccgaaatt

SEQ ID NO: 1637 - DNA, 21 bp, Artificial sequence
  Synthetic sequence: dsRNA targeting HPV E6 Gene Expression. Antisense strand (guide sequence) having double TT overhang
cugggucgcuccugugggutt

SEQ ID NO: 1638 - DNA, 21 bp, Artificial sequence
  Synthetic sequence: dsRNA targeting HPV E6 Gene Expression. Antisense strand (guide sequence) having double TT overhang
agcauauggauucccaucutt

SEQ ID NO: 1639 - DNA, 21 bp, Artificial sequence
  Synthetic sequence: dsRNA targeting HPV E6 Gene Expression. Antisense strand (guide sequence) having double TT overhang
auaaugucuauacucacuatt

SEQ ID NO: 1640 - DNA, 21 bp, Artificial sequence
  Synthetic sequence: dsRNA targeting HPV E6 Gene Expression. Antisense strand (guide sequence) having double TT overhang
cuaauuaacaaaucacacatt

SEQ ID NO: 1641 - DNA, 21 bp, Artificial sequence
  Synthetic sequence: dsRNA targeting HPV E6 Gene Expression. Antisense strand (guide sequence) having double TT overhang
aguuaauacaccuaauuaatt

SEQ ID NO: 1642 - DNA, 21 bp, Artificial sequence
  Synthetic sequence: dsRNA targeting HPV E6 Gene Expression. Antisense strand (guide sequence) having double TT overhang
ccgaaaagcaaagucauautt

SEQ ID NO: 1643 - DNA, 21 bp, Artificial sequence
  Synthetic sequence: dsRNA targeting HPV E6 Gene Expression. Antisense strand (guide sequence) having double TT overhang
acaagacauacaucgaccgtt

SEQ ID NO: 1644 - DNA, 21 bp, Artificial sequence
  Synthetic sequence: dsRNA targeting HPV E6 Gene Expression. Antisense strand (guide sequence) having double TT overhang
gucgcuccuguggguccugtt

SEQ ID NO: 1645 - DNA, 21 bp, Artificial sequence
  Synthetic sequence: dsRNA targeting HPV E6 Gene Expression. Antisense strand (guide sequence) having double TT overhang
uaugcauaaaucccgaaaatt

SEQ ID NO: 1646 - DNA, 21 bp, Artificial sequence
  Synthetic sequence: dsRNA targeting HPV E6 Gene Expression. Antisense strand (guide sequence) having double TT overhang
auaucauguauaguuguuutt

SEQ ID NO: 1647 - DNA, 21 bp, Artificial sequence
  Synthetic sequence: dsRNA targeting HPV E6 Gene Expression. Antisense strand (guide sequence) having double TT overhang
aucacauacagcauauggatt

SEQ ID NO: 1648 - DNA, 21 bp, Artificial sequence
  Synthetic sequence: dsRNA targeting HPV E6 Gene Expression. Antisense strand (guide sequence) having double TT overhang
acucacuaauuuuagaauatt

SEQ ID NO: 1649 - DNA, 21 bp, Artificial sequence
  Synthetic sequence: dsRNA targeting HPV E6 Gene Expression. Antisense strand (guide sequence) having double TT overhang
guucuaauguuguuccauatt

SEQ ID NO: 1650 - DNA, 21 bp, Artificial sequence
  Synthetic sequence: dsRNA targeting HPV E6 Gene Expression. Antisense strand (guide sequence) having double TT overhang
ugaugaucugcaacaagactt

SEQ ID NO: 1651 - DNA, 21 bp, Artificial sequence
  Synthetic sequence: dsRNA targeting HPV E6 Gene Expression. Antisense strand (guide sequence) having double TT overhang
uggcuuuugacaguuaauatt

SEQ ID NO: 1652 - DNA, 21 bp, Artificial sequence
  Synthetic sequence: dsRNA targeting HPV E6 Gene Expression. Antisense strand (guide sequence) having double TT overhang
auugcaguucucuuuuggutt

SEQ ID NO: 1653 - DNA, 21 bp, Artificial sequence
  Synthetic sequence: dsRNA targeting HPV E6 Gene Expression. Antisense strand (guide sequence) having double TT overhang
augucuauacucacuaauutt

SEQ ID NO: 1654 - DNA, 21 bp, Artificial sequence
  Synthetic sequence: dsRNA targeting HPV E6 Gene Expression. Antisense strand (guide sequence) having double TT overhang
acguguucuugaugaucugtt

SEQ ID NO: 1655 - DNA, 21 bp, Artificial sequence
  Synthetic sequence: dsRNA targeting HPV E6 Gene Expression. Antisense strand (guide sequence) having double TT overhang
ucucuauauacuaugcauatt

SEQ ID NO: 1656 - DNA, 21 bp, Artificial sequence
  Synthetic sequence: dsRNA targeting HPV E6 Gene Expression. Antisense strand (guide sequence) having double TT overhang
cauauggauucccaucucutt

SEQ ID NO: 1657 - DNA, 21 bp, Artificial sequence
  Synthetic sequence: dsRNA targeting HPV E6 Gene Expression. Antisense strand (guide sequence) having double TT overhang
aauaaugucuauacucacutt

SEQ ID NO: 1658 - DNA, 21 bp, Artificial sequence
  Synthetic sequence: dsRNA targeting HPV E6 Gene Expression. Antisense strand (guide sequence) having double TT overhang
auacucacuaauuuuagaatt

SEQ ID NO: 1659 - DNA, 21 bp, Artificial sequence
  Synthetic sequence: dsRNA targeting HPV E6 Gene Expression. Antisense strand (guide sequence) having double TT overhang
aucucuauauacuaugcautt

SEQ ID NO: 1660 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (14)..(14): cm
  misc_feature 20: t is deoxy-thymidine-5prime-phosphorothioate
acaucgaccgguccaccgatt

SEQ ID NO: 1661 - DNA, 21 bp, Artificial sequence
  Synthetic sequence: dsRNA targeting HPV E6 Gene Expression. Antisense strand (guide sequence) having double TT overhang
  modified_base (12)..(12): cm
  misc_feature 20: t is deoxy-thymidine-5prime-phosphorothioate
aucgaccgguccaccgacctt

SEQ ID NO: 1662 - DNA, 21 bp, Artificial sequence
  Synthetic sequence: dsRNA targeting HPV E6 Gene Expression. Antisense strand (guide sequence) having double TT overhang
  modified_base (1)..(1): um
  modified_base (3)..(3): cm
  modified_base (15)..(15): cm
  misc_feature 20: t is deoxy-thymidine-5prime-phosphorothioate
uacaucgaccgguccaccgtt

SEQ ID NO: 1663 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (13)..(13): cm
  misc_feature 20: t is deoxy-thymidine-5prime-phosphorothioate
caucgaccgguccaccgactt

SEQ ID NO: 1664 - DNA, 21 bp, Artificial sequence
  Synthetic sequence: dsRNA targeting HPV E6 Gene Expression. Antisense strand (guide sequence) having double TT overhang
  modified_base (3)..(3): um
  misc_feature 20: t is deoxy-thymidine-5prime-phosphorothioate
ucuacguguucuugaugautt

SEQ ID NO: 1665 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (8)..(8): cm
  modified_base (11)..(11): um
  misc_feature 20: t is deoxy-thymidine-5prime-phosphorothioate
cacgucgcaguaacuguugtt

SEQ ID NO: 1666 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (15)..(15): um
  misc_feature 20: t is deoxy-thymidine-5prime-phosphorothioate
acaacgguuuguuguauugtt

SEQ ID NO: 1667 - DNA, 21 bp, Artificial sequence
  Synthetic sequence: dsRNA targeting HPV E6 Gene Expression. Antisense strand (guide sequence) having double TT overhang
  modified_base (4)..(4): um
  modified_base (6)..(6): um
  modified_base (16)..(16): cm
  misc_feature 20: t is deoxy-thymidine-5prime-phosphorothioate
auguauaguuguuugcagctt

SEQ ID NO: 1668 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (4)..(4): cm
  modified_base (16)..(16): cm
  misc_feature 20: t is deoxy-thymidine-5prime-phosphorothioate
auacaucgaccgguccacctt

SEQ ID NO: 1669 - DNA, 21 bp, Artificial sequence
  Synthetic sequence: dsRNA targeting HPV E6 Gene Expression. Antisense strand (guide sequence) having double TT overhang
  modified_base (5)..(5): um
  modified_base (7)..(7): um
  modified_base (11)..(11): cm
  modified_base (14)..(14): um
  misc_feature 20: t is deoxy-thymidine-5prime-phosphorothioate
ugucuauacucacuaauuutt

SEQ ID NO: 1670 - DNA, 21 bp, Artificial sequence
  Synthetic sequence: dsRNA targeting HPV E6 Gene Expression. Antisense strand (guide sequence) having double TT overhang
  modified_base (4)..(4): um
  misc_feature 20: t is deoxy-thymidine-5prime-phosphorothioate
cucuacguguucuugaugatt

SEQ ID NO: 1671 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (4)..(4): cm
  modified_base (17)..(17): um
  misc_feature 20: t is deoxy-thymidine-5prime-phosphorothioate
acacaacgguuuguuguautt

SEQ ID NO: 1672 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (4)..(4): um
  modified_base (6)..(6): cm
  modified_base (18)..(18): cm
  misc_feature 20: t is deoxy-thymidine-5prime-phosphorothioate
acauacaucgaccgguccatt

SEQ ID NO: 1673 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (3)..(3): cm
  modified_base (5)..(5): cm
  modified_base (18)..(18): um
  misc_feature 20: t is deoxy-thymidine-5prime-phosphorothioate
cacacaacgguuuguuguatt

SEQ ID NO: 1674 - DNA, 21 bp, Artificial sequence
  Synthetic sequence: dsRNA targeting HPV E6 Gene Expression. Antisense strand (guide sequence) having double TT overhang
  modified_base (5)..(5): um
  modified_base (7)..(7): um
  modified_base (10)..(10): um
  misc_feature 20: t is deoxy-thymidine-5prime-phosphorothioate
cccuuauauuauggaaucutt

SEQ ID NO: 1675 - DNA, 21 bp, Artificial sequence
  Synthetic sequence: dsRNA targeting HPV E6 Gene Expression. Antisense strand (guide sequence) having double TT overhang
  modified_base (4)..(4): cm
  modified_base (7)..(7): um
  misc_feature 20: t is deoxy-thymidine-5prime-phosphorothioate
ucgcaguaacuguugcuugtt

SEQ ID NO: 1676 - DNA, 21 bp, Artificial sequence
  Synthetic sequence: dsRNA targeting HPV E6 Gene Expression. Antisense strand (guide sequence) having double TT overhang
  modified_base (3)..(3): um
  modified_base (6)..(6): um
  modified_base (8)..(8): cm
  modified_base (12)..(12): um
  modified_base (16)..(16): um
  misc_feature 20: t is deoxy-thymidine-5prime-phosphorothioate
guuaauacaccuaauuaactt

SEQ ID NO: 1677 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (16)..(16): cm
  misc_feature 20: t is deoxy-thymidine-5prime-phosphorothioate
auaaaucccgaaaagcaaatt

SEQ ID NO: 1678 - DNA, 21 bp, Artificial sequence
  Synthetic sequence: dsRNA targeting HPV E6 Gene Expression. Antisense strand (guide sequence) having double TT overhang
  modified_base (14)..(14): cm
  misc_feature 20: t is deoxy-thymidine-5prime-phosphorothioate
aaaucccgaaaagcaaagutt

SEQ ID NO: 1679 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (5)..(5): um
  modified_base (7)..(7): um
  modified_base (17)..(17): cm
  misc_feature 20: t is deoxy-thymidine-5prime-phosphorothioate
cauguauaguuguuugcagtt

SEQ ID NO: 1680 - DNA, 21 bp, Artificial sequence
  Synthetic sequence: dsRNA targeting HPV E6 Gene Expression. Antisense strand (guide sequence) having double TT overhang
  modified_base (11)..(11): cm
  modified_base (17)..(17): cm
  misc_feature 20: t is deoxy-thymidine-5prime-phosphorothioate
ucccgaaaagcaaagucautt

SEQ ID NO: 1681 - DNA, 21 bp, Artificial sequence
  Synthetic sequence: dsRNA targeting HPV E6 Gene Expression. Antisense strand (guide sequence) having double TT overhang
  modified_base (5)..(5): um
  misc_feature 20: t is deoxy-thymidine-5prime-phosphorothioate
gugguaacuuucugggucgtt

SEQ ID NO: 1682 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (7)..(7): cm
  modified_base (14)..(14): cm
  modified_base (17)..(17): um
  misc_feature 20: t is deoxy-thymidine-5prime-phosphorothioate
auaccucacgucgcaguaatt

SEQ ID NO: 1683 - DNA, 21 bp, Artificial sequence
  Synthetic sequence: dsRNA targeting HPV E6 Gene Expression. Antisense strand (guide sequence) having double TT overhang
  modified_base (1)..(1): um
  modified_base (6)..(6): cm
  modified_base (13)..(13): cm
  modified_base (16)..(16): um
  misc_feature 20: t is deoxy-thymidine-5prime-phosphorothioate
uaccucacgucgcaguaactt

SEQ ID NO: 1684 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (4)..(4): um
  modified_base (6)..(6): um
  modified_base (11)..(11): cm
  modified_base (18)..(18): cm
  misc_feature 20: t is deoxy-thymidine-5prime-phosphorothioate
ucauauaccucacgucgcatt

SEQ ID NO: 1685 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (4)..(4): cm
  modified_base (9)..(9): cm
  modified_base (11)..(11): um
  modified_base (13)..(13): cm
  misc_feature 20: t is deoxy-thymidine-5prime-phosphorothioate
caacaagacauacaucgactt

SEQ ID NO: 1686 - DNA, 21 bp, Artificial sequence
  Synthetic sequence: dsRNA targeting HPV E6 Gene Expression. Antisense strand (guide sequence) having double TT overhang
  modified_base (4)..(4): cm
  modified_base (6)..(6): um
  modified_base (8)..(8): um
  modified_base (13)..(13): cm
  misc_feature 20: t is deoxy-thymidine-5prime-phosphorothioate
agucauauaccucacgucgtt

SEQ ID NO: 1687 - DNA, 21 bp, Artificial sequence
  Synthetic sequence: dsRNA targeting HPV E6 Gene Expression. Antisense strand (guide sequence) having double TT overhang
  modified_base (13)..(13): cm
  misc_feature 20: t is deoxy-thymidine-5prime-phosphorothioate
aaucccgaaaagcaaaguctt

SEQ ID NO: 1688 - DNA, 21 bp, Artificial sequence
  Synthetic sequence: dsRNA targeting HPV E6 Gene Expression. Antisense strand (guide sequence) having double TT overhang
  modified_base (4)..(4): cm
  modified_base (8)..(8): um
  modified_base (11)..(11): um
  modified_base (13)..(13): cm
  modified_base (17)..(17): um
  misc_feature 20: t is deoxy-thymidine-5prime-phosphorothioate
ugacaguuaauacaccuaatt

SEQ ID NO: 1689 - DNA, 21 bp, Artificial sequence
  Synthetic sequence: dsRNA targeting HPV E6 Gene Expression. Antisense strand (guide sequence) having double TT overhang
  modified_base (6)..(6): cm
  modified_base (8)..(8): um
  modified_base (17)..(17): um
  misc_feature 20: t is deoxy-thymidine-5prime-phosphorothioate
cugugcauaacugugguaatt

SEQ ID NO: 1690 - DNA, 21 bp, Artificial sequence
  Synthetic sequence: dsRNA targeting HPV E6 Gene Expression. Antisense strand (guide sequence) having double TT overhang
  modified_base (7)..(7): cm
  modified_base (10)..(10): um
  misc_feature 20: t is deoxy-thymidine-5prime-phosphorothioate
acgucgcaguaacuguugctt

SEQ ID NO: 1691 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (4)..(4): um
  modified_base (18)..(18): cm
  misc_feature 20: t is deoxy-thymidine-5prime-phosphorothioate
gcauaaaucccgaaaagcatt

SEQ ID NO: 1692 - DNA, 21 bp, Artificial sequence
  Synthetic sequence: dsRNA targeting HPV E6 Gene Expression. Antisense strand (guide sequence) having double TT overhang
  modified_base (1)..(1): um
  modified_base (8)..(8): um
  modified_base (10)..(10): um
  modified_base (14)..(14): cm
  modified_base (17)..(17): um
  misc_feature 20: t is deoxy-thymidine-5prime-phosphorothioate
uaaugucuauacucacuaatt

SEQ ID NO: 1693 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (5)..(5): um
  modified_base (8)..(8): um
  modified_base (10)..(10): cm
  modified_base (14)..(14): um
  modified_base (18)..(18): um
  misc_feature 20: t is deoxy-thymidine-5prime-phosphorothioate
caguuaauacaccuaauuatt

SEQ ID NO: 1694 - DNA, 21 bp, Artificial sequence
  Synthetic sequence: dsRNA targeting HPV E6 Gene Expression. Antisense strand (guide sequence) having double TT overhang
  modified_base (4)..(4): cm
  modified_base (7)..(7): cm
  modified_base (12)..(12): cm
  modified_base (14)..(14): um
  modified_base (16)..(16): cm
  misc_feature 20: t is deoxy-thymidine-5prime-phosphorothioate
cugcaacaagacauacauctt

SEQ ID NO: 1695 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (6)..(6): cm
  modified_base (8)..(8): um
  modified_base (10)..(10): cm
  misc_feature 20: t is deoxy-thymidine-5prime-phosphorothioate
caagacauacaucgaccggtt

SEQ ID NO: 1696 - DNA, 21 bp, Artificial sequence
  Synthetic sequence: dsRNA targeting HPV E6 Gene Expression. Antisense strand (guide sequence) having double TT overhang
  modified_base (1)..(1): um
  misc_feature 20: t is deoxy-thymidine-5prime-phosphorothioate
uaacuuucugggucgcucctt

SEQ ID NO: 1697 - DNA, 21 bp, Artificial sequence
  Synthetic sequence: dsRNA targeting HPV E6 Gene Expression. Antisense strand (guide sequence) having double TT overhang
  modified_base (2)..(2): um
  misc_feature 20: t is deoxy-thymidine-5prime-phosphorothioate
guaacuuucugggucgcuctt

SEQ ID NO: 1698 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (5)..(5): um
  modified_base (12)..(12): um
  modified_base (14)..(14): um
  modified_base (18)..(18): cm
  misc_feature 20: t is deoxy-thymidine-5prime-phosphorothioate
acaauaaugucuauacucatt

SEQ ID NO: 1699 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (3)..(3): cm
  modified_base (16)..(16): um
  misc_feature 20: t is deoxy-thymidine-5prime-phosphorothioate
cacaacgguuuguuguauutt

SEQ ID NO: 1700 - DNA, 21 bp, Artificial sequence
  Synthetic sequence: dsRNA targeting HPV E6 Gene Expression. Antisense strand (guide sequence) having double TT overhang
  modified_base (7)..(7): cm
  modified_base (10)..(10): cm
  modified_base (15)..(15): cm
  modified_base (17)..(17): um
  misc_feature 20: t is deoxy-thymidine-5prime-phosphorothioate
gaucugcaacaagacauactt

SEQ ID NO: 1701 - DNA, 21 bp, Artificial sequence
  Synthetic sequence: dsRNA targeting HPV E6 Gene Expression. Antisense strand (guide sequence) having double TT overhang
  modified_base (1)..(1): um
  modified_base (15)..(15): cm
  misc_feature 20: t is deoxy-thymidine-5prime-phosphorothioate
uaaaucccgaaaagcaaagtt

SEQ ID NO: 1702 - DNA, 21 bp, Artificial sequence
  Synthetic sequence: dsRNA targeting HPV E6 Gene Expression. Antisense strand (guide sequence) having double TT overhang
  modified_base (7)..(7): um
  modified_base (9)..(9): um
  modified_base (13)..(13): cm
  modified_base (16)..(16): um
  misc_feature 20: t is deoxy-thymidine-5prime-phosphorothioate
aaugucuauacucacuaautt

SEQ ID NO: 1703 - DNA, 21 bp, Artificial sequence
  Synthetic sequence: dsRNA targeting HPV E6 Gene Expression. Antisense strand (guide sequence) having double TT overhang
  modified_base (4)..(4): um
  modified_base (6)..(6): um
  modified_base (9)..(9): um
  misc_feature 20: t is deoxy-thymidine-5prime-phosphorothioate
ccuuauauuauggaaucuutt

SEQ ID NO: 1704 - DNA, 21 bp, Artificial sequence
  Synthetic sequence: dsRNA targeting HPV E6 Gene Expression. Antisense strand (guide sequence) having double TT overhang
  modified_base (3)..(3): cm
  modified_base (8)..(8): cm
  modified_base (10)..(10): um
  modified_base (12)..(12): cm
  misc_feature 20: t is deoxy-thymidine-5prime-phosphorothioate
aacaagacauacaucgacctt

SEQ ID NO: 1705 - DNA, 21 bp, Artificial sequence
  Synthetic sequence: dsRNA targeting HPV E6 Gene Expression. Antisense strand (guide sequence) having double TT overhang
  modified_base (5)..(5): um
  misc_feature 20: t is deoxy-thymidine-5prime-phosphorothioate
ucucuacguguucuugaugtt

SEQ ID NO: 1706 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (9)..(9): cm
  modified_base (12)..(12): um
  misc_feature 20: t is deoxy-thymidine-5prime-phosphorothioate
ucacgucgcaguaacuguutt

SEQ ID NO: 1707 - DNA, 21 bp, Artificial sequence
  Synthetic sequence: dsRNA targeting HPV E6 Gene Expression. Antisense strand (guide sequence) having double TT overhang
  modified_base (3)..(3): cm
  modified_base (10)..(10): cm
  modified_base (13)..(13): um
  misc_feature 20: t is deoxy-thymidine-5prime-phosphorothioate
cucacgucgcaguaacugutt

SEQ ID NO: 1708 - DNA, 21 bp, Artificial sequence
  Synthetic sequence: dsRNA targeting HPV E6 Gene Expression. Antisense strand (guide sequence) having double TT overhang
  modified_base (3)..(3): um
  modified_base (7)..(7): um
  modified_base (10)..(10): cm
  modified_base (15)..(15): cm
  modified_base (17)..(17): cm
  misc_feature 20: t is deoxy-thymidine-5prime-phosphorothioate
ccuaauuaacaaaucacactt

SEQ ID NO: 1709 - DNA, 21 bp, Artificial sequence
  Synthetic sequence: dsRNA targeting HPV E6 Gene Expression. Antisense strand (guide sequence) having double TT overhang
  modified_base (6)..(6): um
  misc_feature 20: t is deoxy-thymidine-5prime-phosphorothioate
uucucuacguguucuugautt

SEQ ID NO: 1710 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (6)..(6): cm
  modified_base (8)..(8): um
  misc_feature 20: t is deoxy-thymidine-5prime-phosphorothioate
cuaugcauaaaucccgaaatt

SEQ ID NO: 1711 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (13)..(13): um
  modified_base (15)..(15): um
  misc_feature 20: t is deoxy-thymidine-5prime-phosphorothioate
cugggucgcuccugugggutt

SEQ ID NO: 1712 - DNA, 21 bp, Artificial sequence
  Synthetic sequence: dsRNA targeting HPV E6 Gene Expression. Antisense strand (guide sequence) having double TT overhang
  modified_base (3)..(3): cm
  modified_base (5)..(5): um
  modified_base (15)..(15): cm
  misc_feature 20: t is deoxy-thymidine-5prime-phosphorothioate
agcauauggauucccaucutt

SEQ ID NO: 1713 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (9)..(9): um
  modified_base (11)..(11): um
  modified_base (15)..(15): cm
  modified_base (18)..(18): um
  misc_feature 20: t is deoxy-thymidine-5prime-phosphorothioate
auaaugucuauacucacuatt

SEQ ID NO: 1714 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (6)..(6): um
  modified_base (9)..(9): cm
  modified_base (14)..(14): cm
  modified_base (16)..(16): cm
  modified_base (18)..(18): cm
  misc_feature 20: t is deoxy-thymidine-5prime-phosphorothioate
cuaauuaacaaaucacacatt

SEQ ID NO: 1715 - DNA, 21 bp, Artificial sequence
  Synthetic sequence: dsRNA targeting HPV E6 Gene Expression. Antisense strand (guide sequence) having double TT overhang
  modified_base (4)..(4): um
  modified_base (7)..(7): um
  modified_base (9)..(9): cm
  modified_base (13)..(13): um
  modified_base (17)..(17): um
  misc_feature 20: t is deoxy-thymidine-5prime-phosphorothioate
aguuaauacaccuaauuaatt

SEQ ID NO: 1716 - DNA, 21 bp, Artificial sequence
  Synthetic sequence: dsRNA targeting HPV E6 Gene Expression. Antisense strand (guide sequence) having double TT overhang
  modified_base (9)..(9): cm
  modified_base (15)..(15): cm
  modified_base (17)..(17): um
  misc_feature 20: t is deoxy-thymidine-5prime-phosphorothioate
ccgaaaagcaaagucauautt

SEQ ID NO: 1717 - DNA, 21 bp, Artificial sequence
  Synthetic sequence: dsRNA targeting HPV E6 Gene Expression. Antisense strand (guide sequence) having double TT overhang
  modified_base (2)..(2): cm
  modified_base (7)..(7): cm
  modified_base (9)..(9): um
  modified_base (11)..(11): cm
  misc_feature 20: t is deoxy-thymidine-5prime-phosphorothioate
acaagacauacaucgaccgtt

SEQ ID NO: 1718 - DNA, 21 bp, Artificial sequence
  Synthetic sequence: dsRNA targeting HPV E6 Gene Expression. Antisense strand (guide sequence) having double TT overhang
  modified_base (9)..(9): um
  modified_base (11)..(11): um
  misc_feature 20: t is deoxy-thymidine-5prime-phosphorothioate
gucgcuccuguggguccugtt

SEQ ID NO: 1719 - DNA, 21 bp, Artificial sequence
  Synthetic sequence: dsRNA targeting HPV E6 Gene Expression. Antisense strand (guide sequence) having double TT overhang
  modified_base (1)..(1): um
  modified_base (5)..(5): cm
  modified_base (7)..(7): um
  misc_feature 20: t is deoxy-thymidine-5prime-phosphorothioate
uaugcauaaaucccgaaaatt

SEQ ID NO: 1720 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (5)..(5): cm
  modified_base (9)..(9): um
  modified_base (11)..(11): um
  misc_feature 20: t is deoxy-thymidine-5prime-phosphorothioate
auaucauguauaguuguuutt

SEQ ID NO: 1721 - DNA, 21 bp, Artificial sequence
  Synthetic sequence: dsRNA targeting HPV E6 Gene Expression. Antisense strand (guide sequence) having double TT overhang
  modified_base (3)..(3): cm
  modified_base (5)..(5): cm
  modified_base (7)..(7): um
  modified_base (9)..(9): cm
  modified_base (12)..(12): cm
  modified_base (14)..(14): um
  misc_feature 20: t is deoxy-thymidine-5prime-phosphorothioate
aucacauacagcauauggatt

SEQ ID NO: 1722 - DNA, 21 bp, Artificial sequence
  Synthetic sequence: dsRNA targeting HPV E6 Gene Expression. Antisense strand (guide sequence) having double TT overhang
  modified_base (4)..(4): cm
  modified_base (7)..(7): um
  modified_base (13)..(13): um
  modified_base (18)..(18): um
  misc_feature 20: t is deoxy-thymidine-5prime-phosphorothioate
acucacuaauuuuagaauatt

SEQ ID NO: 1723 - DNA, 21 bp, Artificial sequence
  Synthetic sequence: dsRNA targeting HPV E6 Gene Expression. Antisense strand (guide sequence) having double TT overhang
  modified_base (5)..(5): um
  modified_base (16)..(16): cm
  modified_base (18)..(18): um
  misc_feature 20: t is deoxy-thymidine-5prime-phosphorothioate
guucuaauguuguuccauatt

SEQ ID NO: 1724 - DNA, 21 bp, Artificial sequence
  Synthetic sequence: dsRNA targeting HPV E6 Gene Expression. Antisense strand (guide sequence) having double TT overhang
  modified_base (11)..(11): cm
  modified_base (14)..(14): cm
  misc_feature 20: t is deoxy-thymidine-5prime-phosphorothioate
ugaugaucugcaacaagactt

SEQ ID NO: 1725 - DNA, 21 bp, Artificial sequence
  Synthetic sequence: dsRNA targeting HPV E6 Gene Expression. Antisense strand (guide sequence) having double TT overhang
  modified_base (11)..(11): cm
  modified_base (15)..(15): um
  modified_base (18)..(18): um
  misc_feature 20: t is deoxy-thymidine-5prime-phosphorothioate
uggcuuuugacaguuaauatt

SEQ ID NO: 1726 - DNA, 21 bp, Artificial sequence
  Synthetic sequence: dsRNA targeting HPV E6 Gene Expression. Antisense strand (guide sequence) having double TT overhang
  modified_base (5)..(5): cm
  misc_feature 20: t is deoxy-thymidine-5prime-phosphorothioate
auugcaguucucuuuuggutt

SEQ ID NO: 1727 - DNA, 21 bp, Artificial sequence
  Synthetic sequence: dsRNA targeting HPV E6 Gene Expression. Antisense strand (guide sequence) having double TT overhang
  modified_base (6)..(6): um
  modified_base (8)..(8): um
  modified_base (12)..(12): cm
  modified_base (15)..(15): um
  misc_feature 20: t is deoxy-thymidine-5prime-phosphorothioate
augucuauacucacuaauutt

SEQ ID NO: 1728 - DNA, 21 bp, Artificial sequence
  Synthetic sequence: dsRNA targeting HPV E6 Gene Expression. Antisense strand (guide sequence) having double TT overhang
  modified_base (4)..(4): um
  modified_base (10)..(10): um
  modified_base (13)..(13): um
  modified_base (18)..(18): um
  misc_feature 20: t is deoxy-thymidine-5prime-phosphorothioate
acguguucuugaugaucugtt

SEQ ID NO: 1729 - DNA, 21 bp, Artificial sequence
  Synthetic sequence: dsRNA targeting HPV E6 Gene Expression. Antisense strand (guide sequence) having double TT overhang
  modified_base (5)..(5): um
  modified_base (7)..(7): um
  modified_base (9)..(9): um
  modified_base (12)..(12): um
  modified_base (16)..(16): cm
  modified_base (18)..(18): um
  misc_feature 20: t is deoxy-thymidine-5prime-phosphorothioate
ucucuauauacuaugcauatt

SEQ ID NO: 1730 - DNA, 21 bp, Artificial sequence
  Synthetic sequence: dsRNA targeting HPV E6 Gene Expression. Antisense strand (guide sequence) having double TT overhang
  modified_base (1)..(1): cm
  modified_base (3)..(3): um
  modified_base (13)..(13): cm
  misc_feature 20: t is deoxy-thymidine-5prime-phosphorothioate
cauauggauucccaucucutt

SEQ ID NO: 1731 - DNA, 21 bp, Artificial sequence
  Synthetic sequence: dsRNA targeting HPV E6 Gene Expression. Antisense strand (guide sequence) having double TT overhang
  modified_base (3)..(3): um
  modified_base (10)..(10): um
  modified_base (12)..(12): um
  modified_base (16)..(16): cm
  misc_feature 20: t is deoxy-thymidine-5prime-phosphorothioate
aauaaugucuauacucacutt

SEQ ID NO: 1732 - DNA, 21 bp, Artificial sequence
  Synthetic sequence: dsRNA targeting HPV E6 Gene Expression. Antisense strand (guide sequence) having double TT overhang
  modified_base (2)..(2): um
  modified_base (6)..(6): cm
  modified_base (9)..(9): um
  modified_base (15)..(15): um
  misc_feature 20: t is deoxy-thymidine-5prime-phosphorothioate
auacucacuaauuuuagaatt

SEQ ID NO: 1733 - DNA, 21 bp, Artificial sequence
  Synthetic sequence: dsRNA targeting HPV E6 Gene Expression. Antisense strand (guide sequence) having double TT overhang
  modified_base (6)..(6): um
  modified_base (8)..(8): um
  modified_base (10)..(10): um
  modified_base (13)..(13): um
  modified_base (17)..(17): cm
  misc_feature 20: t is deoxy-thymidine-5prime-phosphorothioate
aucucuauauacuaugcautt

SEQ ID NO: 1734 - DNA, 21 bp, Artificial sequence
  Synthetic sequence: dsRNA targeting HPV E6 Gene Expression. Antisense strand (guide sequence) having double TT overhang
caccuaauuaacaaaucactt

SEQ ID NO: 1735 - DNA, 21 bp, Artificial sequence
  Synthetic sequence: dsRNA targeting HPV E6 Gene Expression. Antisense strand (guide sequence) having double TT overhang
acaccuaauuaacaaaucatt

SEQ ID NO: 1736 - DNA, 21 bp, Artificial sequence
  Synthetic sequence: dsRNA targeting HPV E6 Gene Expression. Antisense strand (guide sequence) having double TT overhang
uacaccuaauuaacaaauctt

SEQ ID NO: 1737 - DNA, 21 bp, Artificial sequence
  Synthetic sequence: dsRNA targeting HPV E6 Gene Expression. Antisense strand (guide sequence) having double TT overhang
auacaccuaauuaacaaautt

SEQ ID NO: 1738 - DNA, 21 bp, Artificial sequence
  Synthetic sequence: dsRNA targeting HPV E6 Gene Expression. Antisense strand (guide sequence) having double TT overhang
accuaauuaacaaaucacatt

SEQ ID NO: 1739 - DNA, 21 bp, Artificial sequence
  Synthetic sequence: dsRNA targeting HPV E6 Gene Expression. Antisense strand (guide sequence) having double TT overhang
ucuaauguuguuccauacatt

SEQ ID NO: 1740 - DNA, 21 bp, Artificial sequence
  Synthetic sequence: dsRNA targeting HPV E6 Gene Expression. Antisense strand (guide sequence) having double TT overhang
uucuaauguuguuccauactt

SEQ ID NO: 1741 - DNA, 21 bp, Artificial sequence
  Synthetic sequence: dsRNA targeting HPV E6 Gene Expression. Antisense strand (guide sequence) having double TT overhang
cuguugcuugcaguacacatt

SEQ ID NO: 1742 - DNA, 21 bp, Artificial sequence
  Synthetic sequence: dsRNA targeting HPV E6 Gene Expression. Antisense strand (guide sequence) having double TT overhang
auauaccucacgucgcagutt

SEQ ID NO: 1743 - DNA, 21 bp, Artificial sequence
  Synthetic sequence: dsRNA targeting HPV E6 Gene Expression. Antisense strand (guide sequence) having double TT overhang
aagcaaagucauauaccuctt

SEQ ID NO: 1744 - DNA, 21 bp, Artificial sequence
  Synthetic sequence: dsRNA targeting HPV E6 Gene Expression. Antisense strand (guide sequence) having double TT overhang
cauuuaucacauacagcautt

SEQ ID NO: 1745 - DNA, 21 bp, Artificial sequence
  Synthetic sequence: dsRNA targeting HPV E6 Gene Expression. Antisense strand (guide sequence) having double TT overhang
ucacuaauuuuagaauaaatt

SEQ ID NO: 1746 - DNA, 21 bp, Artificial sequence
  Synthetic sequence: dsRNA targeting HPV E6 Gene Expression. Antisense strand (guide sequence) having double TT overhang
cauauaccucacgucgcagtt

SEQ ID NO: 1747 - DNA, 21 bp, Artificial sequence
  Synthetic sequence: dsRNA targeting HPV E6 Gene Expression. Antisense strand (guide sequence) having double TT overhang
uaacaaaucacacaacggutt

SEQ ID NO: 1748 - DNA, 21 bp, Artificial sequence
  Synthetic sequence: Chemically modified dsRNA targeting E6AP; sense strand
  modified_base (1)..(1): cm
  modified_base (2)..(2): um
  modified_base (3)..(3): cm
  modified_base (8)..(8): um
  modified_base (9)..(10): cm
  modified_base (11)..(11): um
  modified_base (14)..(15): um
  modified_base (17)..(17): um
  modified_base (18)..(18): cm
  modified_base (19)..(19): um
  misc_feature (20)..(20): t is deoxy-thymidine-5prime-phosphorothioate
cucgagauccuaauuaucutt

SEQ ID NO: 1749 - DNA, 21 bp, Artificial sequence
  Synthetic sequence: Chemically modified dsRNA targeting E6AP; antisense strand
  modified_base (4)..(4): um
  modified_base (7)..(8): um
  misc_feature (20)..(20): t is deoxy-thymidine-5prime-phosphorothioate
agauaauuaggaucucgagtt

SEQ ID NO: 1750 - RNA, 23 nt, Artificial sequence
  Synthetic sequence: Target sequence of mRNA from HPV E6 reference sequence (sequence of total 19mer target site + aa at both ends)
aaucgguggaccggucgauguaa

We claim:

1. A double-stranded ribonucleic acid (dsRNA) for inhibiting the expression of a human E6AP gene in a cell, wherein said dsRNA comprises at least two sequences that are complementary to each other and wherein a sense strand comprises a first sequence and an antisense strand comprises a second sequence comprising a region of complementarity which is complementary to at least 15 contiguous nucleotides of SEQ ID NO:1, and wherein said region of complementarity is less than 30 nucleotides in length and wherein said dsRNA, upon contact with a cell expressing said E6AP, inhibits expression of said E6AP gene by at least 40% as compared to a control cell.

2. The dsRNA of claim 1, wherein the second sequence comprises SEQ ID NO:313.

3. The dsRNA of claim 1, wherein said dsRNA comprises at least one modified nucleotide.

4. The dsRNA of claim 2, wherein said dsRNA comprises at least one modified nucleotide.

5. The dsRNA of claim 4, wherein said modified nucleotide is chosen from the group of: a 2'-O-methyl modified nucleotide, a nucleotide comprising a 5'-phosphorothioate group, and a terminal nucleotide linked to a cholesteryl derivative or dodecanoic acid bisdecylamide group.

6. The dsRNA of claim 4, wherein said modified nucleotide is chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

7. A cell comprising the dsRNA of claim 1.

8. A pharmaceutical composition for inhibiting the expression of the E6AP gene in an organism, comprising the dsRNA of claim 1 and a pharmaceutically acceptable carrier.

9. The pharmaceutical composition of claim 8, wherein the first sequence comprises SEQ ID NO:157 and the second comprises SEQ ID NO:313.

10. A method for inhibiting the expression of the E6AP gene in a cell, the method comprising:
    (a) introducing into the cell the dsRNA of claim 1; and
    (b) maintaining the cell produced in step (a) for a time sufficient to obtain degradation of the mRNA transcript of the E6AP gene, thereby inhibiting expression of the E6AP gene in the cell.

11. A vector for inhibiting the expression of the E6AP gene in a cell, said vector comprising a regulatory sequence operably linked to a nucleotide sequence that encodes at least one strand of the dsRNA of claim 1.

12. A cell comprising the vector of claim 11.

13. The dsRNA of claim 1, wherein said contact is performed in vitro at 30 nM or less.

14. The dsRNA of claim 2, wherein the second sequence consists of SEQ ID NO:313.

15. The dsRNA of claim 2, wherein the first sequence comprises SEQ ID NO:157 and the second sequence comprises SEQ ID NO:313.

16. The dsRNA of claim 2, wherein the first sequence consists of SEQ ID NO:157 and the second sequence consists of SEQ ID NO:313.

17. The dsRNA of claim 1, wherein the second sequence consists of SEQ ID NO:313.

18. The dsRNA of claim 4, wherein said modified nucleotide is a 2'-O-methyl modified nucleotide.

19. The dsRNA of claim 4, wherein said modified nucleotide is a 5'-phosphorothioate group.

20. The pharmaceutical composition of claim 8, wherein the first sequence consists of SEQ ID NO:157 and the second consists of SEQ ID NO:313.

* * * * *